United States Patent
Thompson et al.

(10) Patent No.: US 12,031,164 B2
(45) Date of Patent: Jul. 9, 2024

(54) FUSION PROTEINS, RECOMBINANT BACTERIA, AND EXOSPORIUM FRAGMENTS FOR PLANT HEALTH

(71) Applicant: Spogen Biotech Inc., St. Louis, MO (US)

(72) Inventors: Brian M. Thompson, Creve Coeur, MO (US); Jorg Augustin, Chesterfield, MO (US); Ashley Siegel, St. Louis, MO (US)

(73) Assignee: Spogen Biotech Inc., St. Louis, MO (US)

( * ) Notice: Subject to any disclaimer, the term of this patent is extended or adjusted under 35 U.S.C. 154(b) by 903 days.

(21) Appl. No.: 16/648,810

(22) PCT Filed: Sep. 20, 2018

(86) PCT No.: PCT/US2018/051995
§ 371 (c)(1),
(2) Date: Mar. 19, 2020

(87) PCT Pub. No.: WO2019/060574
PCT Pub. Date: Mar. 28, 2019

(65) Prior Publication Data
US 2020/0216828 A1 Jul. 9, 2020

Related U.S. Application Data

(60) Provisional application No. 62/560,876, filed on Sep. 20, 2017.

(51) Int. Cl.
| | | |
|---|---|---|
| *C12N 9/78* | (2006.01) | |
| *A01N 63/22* | (2020.01) | |
| *A23K 10/18* | (2016.01) | |
| *A23K 20/189* | (2016.01) | |
| *A61K 9/00* | (2006.01) | |
| *A61K 35/742* | (2015.01) | |
| *A61K 38/00* | (2006.01) | |
| *C07K 14/32* | (2006.01) | |
| *C12N 9/24* | (2006.01) | |
| *C12N 9/42* | (2006.01) | |

(52) U.S. Cl.
CPC .............. *C12N 9/78* (2013.01); *A01N 63/22* (2020.01); *A23K 10/18* (2016.05); *A23K 20/189* (2016.05); *A61K 9/0056* (2013.01); *A61K 35/742* (2013.01); *C07K 14/32* (2013.01); *C12N 9/2402* (2013.01); *C12N 9/2434* (2013.01); *C12Y 302/01151* (2013.01); *C12Y 305/99007* (2013.01); *A61K 38/00* (2013.01); *C07K 2319/035* (2013.01)

(58) Field of Classification Search
CPC ...... C12N 9/78; C12N 9/2402; C12N 9/2434; A01N 63/22; A23K 10/18; A23K 20/189; A61K 9/0056; A61K 35/742; A61K 38/00; C07K 14/32; C07K 2319/035; C12Y 302/01151; C12Y 305/99007
See application file for complete search history.

(56) References Cited

U.S. PATENT DOCUMENTS

| | | |
|---|---|---|
| 5,290,914 A | 3/1994 | Wilcox et al. |
| 5,348,743 A | 9/1994 | Ryals et al. |
| 5,466,449 A | 11/1995 | Witold |
| 5,503,652 A | 4/1996 | Kloepper et al. |
| 5,631,007 A | 5/1997 | Ryals et al. |
| 5,766,914 A | 6/1998 | Deits |
| 5,776,448 A | 7/1998 | Suslow et al. |
| 5,858,962 A | 1/1999 | Blackburn et al. |
| 5,958,104 A | 9/1999 | Nonomura et al. |
| 6,110,372 A | 8/2000 | Perriello |
| 6,184,440 B1 | 2/2001 | Shoseyov et al. |
| 6,232,270 B1 | 5/2001 | Branly et al. |

(Continued)

FOREIGN PATENT DOCUMENTS

| | | |
|---|---|---|
| CA | 2146822 A1 | 10/1995 |
| CN | 101056536 | 10/2007 |

(Continued)

OTHER PUBLICATIONS

Genbank P33378. Phospholipase C. 2014. p. 1-3 (Year: 2014).*

(Continued)

*Primary Examiner* — Paul J Holland
(74) *Attorney, Agent, or Firm* — Dentons US LLP

(57) ABSTRACT

Fusion proteins containing a targeting sequence, exosporium protein, or exosporium protein fragment that targets the fusion protein to the exosporium of a recombinant *Bacillus cereus* family member are provided. The fusion proteins further comprise an enzyme having ACC deaminase activity, a phospholipase, a lipase, a xylanase, a xylosidase, a lactonase, a chitosanase, a protease, a glucanase, a phytase, an acid phosphatase, a pectinase, a mannanase, and/or an expansin protein. Also provided are recombinant *Bacillus cereus* family members that express the fusion proteins, exosporium fragments derived from the recombinant *Bacillus cereus* family members, and formulations containing the recombinant *Bacillus cereus* family members or exosporium fragments. Plant seeds treated with the recombinant *Bacillus cereus* family members, exosporium fragments, or formulations are also provided. The invention further relates to methods for stimulating plant growth and/or promoting plant health using the recombinant *Bacillus cereus* family members, exosporium fragments, or formulations.

9 Claims, 14 Drawing Sheets

Figure 2:
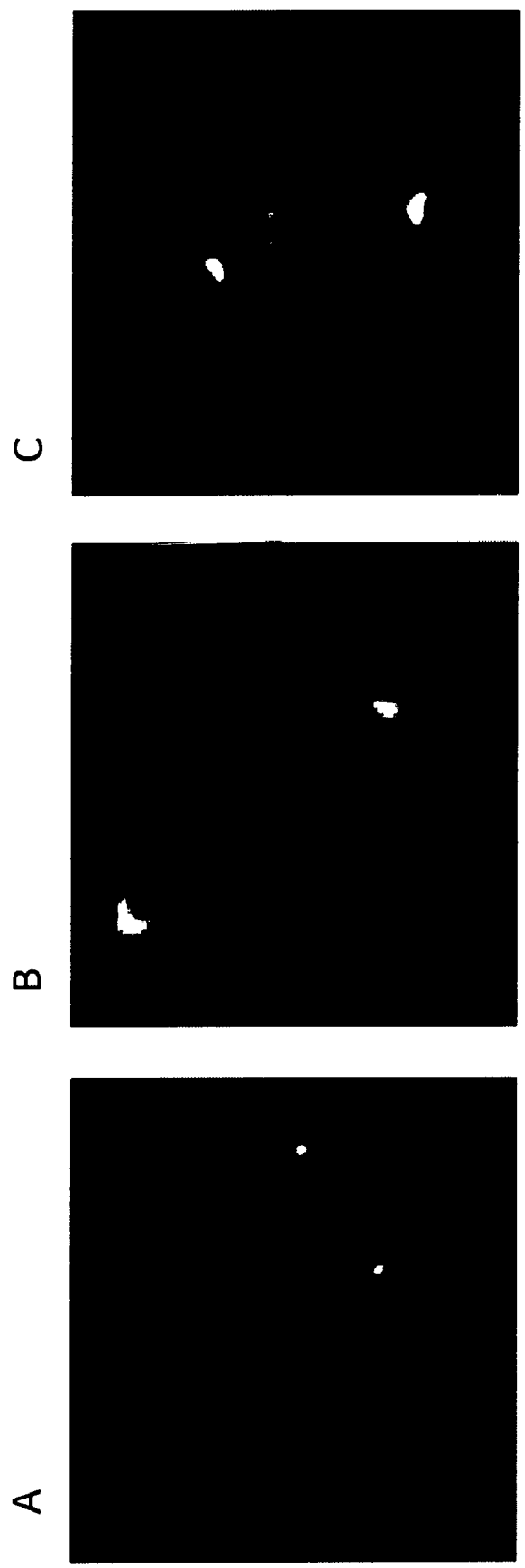

Specification includes a Sequence Listing.

(56) References Cited

U.S. PATENT DOCUMENTS

| | | |
|---|---|---|
| 6,309,440 B1 | 10/2001 | Yamashita |
| 6,323,023 B1 | 11/2001 | Shoseyov et al. |
| 6,333,302 B1 | 12/2001 | Beer et al. |
| 6,346,131 B1 | 2/2002 | Bergevin |
| 6,548,743 B1 | 4/2003 | Sheen et al. |
| 6,566,114 B1 | 5/2003 | Kauppinen et al. |
| 6,630,340 B2 | 10/2003 | Wilting et al. |
| 7,393,678 B2 | 7/2008 | Triplett et al. |
| 7,417,181 B2 | 8/2008 | Wang et al. |
| 7,432,097 B2 | 10/2008 | Short et al. |
| 7,504,120 B2 | 3/2009 | Steer et al. |
| 7,615,681 B2 | 11/2009 | Georges et al. |
| 7,919,678 B2 | 4/2011 | Mironov |
| 7,960,148 B2 | 6/2011 | Steer et al. |
| 8,030,064 B2 | 10/2011 | Lee et al. |
| 8,080,404 B1 | 12/2011 | Turetsky et al. |
| 8,097,769 B2 | 1/2012 | Sarria-Millan et al. |
| 8,105,613 B2 | 1/2012 | Flick-Smith et al. |
| 8,114,659 B2 | 2/2012 | Rawson et al. |
| 8,383,366 B2 | 2/2013 | Ferrari et al. |
| 8,461,419 B2 | 6/2013 | He et al. |
| 8,614,078 B2 | 12/2013 | Lin et al. |
| 8,673,311 B2 | 3/2014 | Cutting et al. |
| 9,068,189 B2 | 6/2015 | Mishra et al. |
| 9,068,194 B2 | 6/2015 | Unkefer et al. |
| 9,125,419 B2 | 9/2015 | Asolkar et al. |
| 9,132,175 B2 | 9/2015 | Stewart et al. |
| 9,133,251 B2 | 9/2015 | Stewart et al. |
| 9,392,796 B2 | 7/2016 | Thompson et al. |
| 9,540,633 B2 | 1/2017 | Brinch-Pedersen et al. |
| 9,573,980 B2 | 2/2017 | Thompson et al. |
| 9,713,632 B2 | 7/2017 | van der Weerden |
| 9,826,743 B2 | 11/2017 | Curtis et al. |
| 9,845,342 B2 | 12/2017 | Thompson et al. |
| 9,850,289 B2 | 12/2017 | Thompson et al. |
| 9,956,277 B2 | 5/2018 | Stewart et al. |
| 10,081,790 B2 | 9/2018 | Stewart et al. |
| 10,092,009 B2 | 10/2018 | Thompson et al. |
| 10,349,660 B2 | 7/2019 | Thompson et al. |
| 10,407,472 B2 | 9/2019 | Thompson et al. |
| 10,448,647 B2 | 10/2019 | Curtis et al. |
| 10,555,532 B2 | 2/2020 | Thompson et al. |
| 10,555,534 B2 | 2/2020 | Thompson et al. |
| 10,667,522 B2 | 6/2020 | Curtis et al. |
| 10,851,027 B2 | 12/2020 | Adam |
| 11,124,460 B2 | 9/2021 | Thompson et al. |
| 11,134,681 B2 | 10/2021 | Thompson et al. |
| 11,406,107 B2 | 8/2022 | Curtis et al. |
| 11,882,829 B2 | 1/2024 | Thompson et al. |
| 11,905,315 B2 | 2/2024 | Thompson et al. |
| 2003/0167506 A1 | 9/2003 | Multani et al. |
| 2003/0228679 A1 | 12/2003 | Smith et al. |
| 2004/0077090 A1 | 4/2004 | Short |
| 2005/0232947 A1 | 10/2005 | Cutting |
| 2007/0184018 A1 | 8/2007 | Lahm et al. |
| 2008/0233175 A1 | 9/2008 | Steer et al. |
| 2008/0248953 A1 | 10/2008 | Smith et al. |
| 2009/0099079 A1 | 4/2009 | Emalfarb et al. |
| 2009/0192040 A1 | 7/2009 | Grobler |
| 2010/0071093 A1 | 3/2010 | Sarria-Millan |
| 2010/0205690 A1 | 8/2010 | Blasing et al. |
| 2010/0233124 A1 | 9/2010 | Stewart et al. |
| 2010/0291100 A1 | 11/2010 | Macinga |
| 2011/0281316 A1 | 11/2011 | Stewart et al. |
| 2011/0321197 A1 | 12/2011 | Schon et al. |
| 2012/0227134 A1 | 9/2012 | Schon et al. |
| 2012/0259101 A1 | 10/2012 | Tan et al. |
| 2012/0266327 A1 | 10/2012 | Sanz Molinero et al. |
| 2013/0116124 A1 | 5/2013 | Baroja Fernandez et al. |
| 2013/0216653 A1 | 8/2013 | Perkins et al. |
| 2013/0345056 A1 | 12/2013 | Sada |
| 2014/0031576 A1 | 1/2014 | Toriumi |
| 2014/0259225 A1 | 9/2014 | Frank et al. |
| 2014/0274691 A1 | 9/2014 | Thompson et al. |
| 2014/0274707 A1 | 9/2014 | Thompson et al. |
| 2014/0294883 A1 | 10/2014 | Poobalane et al. |
| 2014/0308748 A1 | 10/2014 | Mishra et al. |
| 2014/0342905 A1 | 11/2014 | Bullis et al. |
| 2015/0274605 A1 | 10/2015 | Waldron et al. |
| 2015/0296785 A1 | 10/2015 | Sawada et al. |
| 2016/0031948 A1 | 2/2016 | Thompson et al. |
| 2016/0051656 A1 | 2/2016 | Stewart et al. |
| 2016/0053222 A1 | 2/2016 | Stewart et al. |
| 2016/0073640 A1 | 3/2016 | Curtis et al. |
| 2016/0108096 A1 | 4/2016 | Thompson et al. |
| 2016/0236996 A1 | 8/2016 | Chaudhry |
| 2016/0262402 A1 | 9/2016 | Thompson et al. |
| 2016/0316761 A1 | 11/2016 | Thompson et al. |
| 2016/0340658 A1 | 11/2016 | Lessl et al. |
| 2017/0135353 A1 | 5/2017 | Thompson et al. |
| 2017/0283472 A1 | 10/2017 | Curtis et al. |
| 2017/0290339 A1 | 10/2017 | Curtis et al. |
| 2017/0295785 A1 | 10/2017 | Curtis et al. |
| 2017/0295797 A1 | 10/2017 | Curtis et al. |
| 2017/0295798 A1 | 10/2017 | Curtis et al. |
| 2017/0318808 A1 | 11/2017 | Curtis et al. |
| 2017/0347664 A1 | 12/2017 | Thompson et al. |
| 2017/0356002 A1 | 12/2017 | Thompson et al. |
| 2018/0250377 A1 | 9/2018 | Stewart et al. |
| 2019/0116801 A1 | 4/2019 | Thompson et al. |
| 2020/0029573 A1 | 1/2020 | Riggs |
| 2020/0107552 A1 | 4/2020 | Thompson et al. |
| 2020/0190149 A1 | 6/2020 | Thompson et al. |
| 2020/0296960 A1 | 9/2020 | Curtis et al. |
| 2022/0055961 A1 | 2/2022 | Thompson et al. |
| 2022/0135492 A1 | 5/2022 | Thompson et al. |
| 2023/0069595 A1 | 3/2023 | Curtis et al. |
| 2023/0134066 A1 | 5/2023 | Thompson et al. |
| 2023/0322642 A1 | 10/2023 | Thompson et al. |
| 2024/0109819 A1 | 4/2024 | Thompson et al. |
| 2024/0132417 A1 | 4/2024 | Thompson et al. |
| 2024/0132418 A1 | 4/2024 | Thompson et al. |
| 2024/0132419 A1 | 4/2024 | Thompson et al. |

FOREIGN PATENT DOCUMENTS

| | | |
|---|---|---|
| CN | 101919407 A | 12/2010 |
| CN | 102031231 A | 4/2011 |
| CN | 101481666 | 8/2011 |
| CN | 103086784 | 5/2013 |
| CN | 103086784 A | 5/2013 |
| CN | 103443278 A | 12/2013 |
| CN | 104945164 A | 9/2015 |
| EP | 1359134 A1 | 5/2003 |
| EP | 0792363 B1 | 12/2003 |
| EP | 0901527 B1 | 8/2005 |
| EP | 1465980 B1 | 8/2010 |
| EP | 1590466 B1 | 9/2010 |
| EP | 2561760 A2 | 2/2013 |
| EP | 2069504 B1 | 6/2015 |
| EP | 2658961 B1 | 8/2015 |
| IN | 801/CHE/2011 | 7/2014 |
| JP | H10-203917 A | 8/1998 |
| JP | 2005-298409 A | 10/2005 |
| JP | 2007-117066 A | 5/2007 |
| KR | 10-2011-0102787 A | 9/2011 |
| RU | 2160778 C1 | 12/2000 |
| RU | 2 313 941 C2 | 1/2008 |
| RU | 2439148 C1 | 1/2012 |
| RU | 2 458 132 C2 | 8/2012 |
| WO | 96/23063 A1 | 8/1999 |
| WO | 02/00232 A2 | 1/2002 |
| WO | 02/45513 A2 | 6/2002 |
| WO | 02/46388 A1 | 6/2002 |
| WO | 03/011487 A1 | 2/2003 |
| WO | 03/066846 A1 | 8/2003 |
| WO | 2005/028654 A1 | 3/2005 |
| WO | 2006/012366 A2 | 2/2006 |
| WO | 2007/078127 A1 | 7/2007 |
| WO | 2007/086898 A2 | 8/2007 |
| WO | 2008/017483 A2 | 2/2008 |
| WO | 2009/037329 A2 | 3/2009 |
| WO | 2009/056494 A2 | 5/2009 |
| WO | 2010/046221 A1 | 4/2010 |

(56) References Cited

FOREIGN PATENT DOCUMENTS

| | | | |
|---|---|---|---|
| WO | 2011/106794 | A1 | 9/2011 |
| WO | 2011/121408 | A1 | 10/2011 |
| WO | 2013/090628 | A1 | 6/2013 |
| WO | 2013/102934 | A1 | 7/2013 |
| WO | 2013/110591 | A1 | 8/2013 |
| WO | 2013/178649 | A1 | 12/2013 |
| WO | 2013/178650 | A1 | 12/2013 |
| WO | 2013/178658 | A1 | 12/2013 |
| WO | 2014/004487 | A1 | 1/2014 |
| WO | 2014/079773 | A1 | 5/2014 |
| WO | 2014/079814 | A1 | 5/2014 |
| WO | 2014/145964 | A1 | 9/2014 |
| WO | 2015/118516 | A1 | 8/2015 |
| WO | 2016/044529 | | 3/2016 |
| WO | 2016/044548 | | 3/2016 |
| WO | 2016/044575 | | 3/2016 |
| WO | 2016/044661 | A1 | 3/2016 |
| WO | 2016044533 | | 3/2016 |
| WO | 2016044542 | | 3/2016 |
| WO | 2016044563 | | 3/2016 |

OTHER PUBLICATIONS

Singh RK et al. Protein Engineering Approaches in the Post-Genomic Era. 2017. Current Protein and Peptide Science. 18, 1-11. (Year: 2017).*

Zhang M et al. Propagated Perturbations from a Peripheral Mutation Show Interactions Supporting WW Domain Thermostability. 2018. Structure. 26, 1474-1485. (Year: 2018).*

Reetha, S., et al., "Screening of Cellulase and Pectinase by Using Pseudomonas Fluorescens and Bacillus subtilis," International Letters of Natural Sciences, 2014, pp. 75-80, vol. 8, No. 2.

Ryu, C. M., et al., "Bacterial Volatiles Promote Growth in *Arabidopsis*," Proceedings of the National Academy of Sciences of the United States of America, Apr. 2003, pp. 4927-4932, vol. 100, No. 8.

Sachdev, D. P., et al., "Isolation and Characterization of Indole Acetic Acid (IAA) Producing Klebsiella pneumoniae Strains from Rhizosphere of Wheat (*Triticum aestivum*) and Their Effect on Plant Growth," Indian Journal of Experimental Biology, Dec. 2009, pp. 993-1000, vol. 47, No. 12.

Saleh, S., et al., "Involvement of gacS and rpoS in Enhancement of the Plant Growth-Promoting Capabilities of Enterobacter cloacae CAL2 and UW4," Canadian Journal of Microbiology, Aug. 2001, pp. 698-705, vol. 47, No. 8.

Sales, J., et al. "Coffee (*Coffea arabica* L.) Seeds Germination After Treatment with Different Concentrations and Embebding Times in Cellulase," Ciencia e Agrotecnologia [online], 2003, pp. 557-564, vol. 27, No. 3, ISSN 1413-7054. http://dx.doi.org/10.1590/S1413-70542003000300009, Abstract Only, 1 page.

Selvakumar, G., et al., "Isolation and Characterization of Nonrhizobial Plant Growth Promoting Bacteria from Nodules of Kudzu (*Pueraria thunbergiana*) and Their Effect on Wheat Seedling Growth," Current Microbiology, Feb. 2008, pp. 134-139, vol. 56, Issue 2.

Sequence Listing filed in WO 2007/078127 A1 published Jul. 12, 2007, downloaded from <http://patentscope.wipo.int/search/en/detail.jsf?docId=WO2007078127&recNum=1&tab=PCTDocuments&maxRec=&office=&prevFilter=&sortOption=&queryString=>, 5 pages.

Shahid, M., et al., "Root Colonization and Growth Promotion of Sunflower (*Helianthus annuus* L.) by Phosphate Solubilizing *Enterobacter* sp. Fs-11," World Journal of Microbiology & Biotechnology, 2012, pp. 2749-2758, vol. 28, No. 8.

Shani, Z., et al., "Expression of Endo-1,4-beta-glucanase (cel1) in *Arabidopsis thaliana* is Associated with Plant Growth, Xylem Development and Cell Wall Thickening," Plant Cell Reports, 2006, pp. 1067-1074, vol. 25, Issue 10.

Shankar, M., et al., "Root Colonization of a Rice Growth Promoting Strain of Enterobacter cloacae," Journal of Basic Microbiology, 2011, pp. 523-530, vol. 51, No. 5.

Shao, J., et al., "Contribution of Indole-3-Acetic Acid in the Plant Growth Promotion by the Rhizospheric Strain Bacillus amyloliquefaciens SQR9," Biology and Fertility of Soils, 2015, pp. 321-330, vol. 51, Issue 3.

Shen, M., et al., "Effect of Plant Growth-Promoting Rhizobacteria (PGPRs) on Plant Growth, Yield, and Quality of Tomato (*Lycopersicon esculentum* Mill.) under Simulated Seawater Irrigation," The Journal of General and Applied Microbiology, 2012, pp. 253-262, vol. 58, No. 4.

Siddikee, Md. A., et al., "Halotolerant Bacteria with ACC Deaminase Activity Alleviate Salt Stress Effect in Canola Seed Germination," Journal of the Korean Society for Applied Biological Chemistry, 2015, pp. 237-241, vol. 58, Issue 2.

Singh, B., et al., "Microbial Phytases in Phosphorous Acquisition and Plant Growth Promotion," Physiology and Molecular Biology of Plants, 2011, pp. 93-103, vol. 17, Issue 2.

Singh, B., et al., "Plant Growth Promotion by an Extracellular HAP-Phytase of a Thermophilic Mold Sporotrichum thermophile," Applied Biochemistry and Biotechnology, 2010, pp. 1267-1276, vol. 160, Issue 5.

Smirnova, I., et al., "The Effect of Inoculation by Cellulolytic Bacteria *Bacillus cytaseus* on Wheat Productivity," Institute of Microbiology and Virology Ministry of Education and Science, Kazakhstan, Almaty, pp. 185-191.

Stearns, J. C., et al., "Effects of Bacterial ACC Deaminase on *Brassica napus* Gene Expression," Molecular Plant-Microbe Interactions, May 2012, pp. 668-676, vol. 25, No. 5.

Steichen, C. T., et al., "Non-Uniform Assembly of the Bacillus anthracis Exosporium and a Bottle Cap Model for Spore Germination and Outgrowth," Molecular Microbiology, Apr. 2007, pp. 359-367, vol. 64, Issue 2.

Tan, L., et al., "An Unusual Mechanism of Isopeptide Bond Formation Attaches the Collagenlike Glycoprotein BclA to the Exosporium of Bacillus anthracis," mBio, May-Jun. 2011, 20 pages, vol. 2, No. 3.

Tan, L., et al., "An Unusual Mechanism of Isopeptide Bond Formation Attaches the Collagenlike Glycoprotein BclA to the Exosporium of Bacillus anthracis," mBio, May-Jun. 2011, 20 pages, vol. 2, No. 3 (Retraction).

Tan, L., et al., "Sequence Motifs and Proteolytic Cleavage of the Collagen-Like Glycoprotein BclA Required for Its Attachment to the Exosporium of Bacillus anthracis," Journal of Bacteriology, Mar. 2010, pp. 1259-1268, vol. 192, No. 5.

Thomas, P., et al., "Endophytic Bacteria Associated with Growing Shoot Tips of Banana (*Musa* sp.) cv. Grand Naine and the Affinity of Endophytes to the Host," Microbial Ecology, 2009, pp. 952-964, vol. 58, No. 4.

Thompson, B. M., "The Role of the Glycoprotein BclB in the Exosporium in the Exosporium of Bacillus Anthracis," Doctoral Dissertation presented to the Department of Diagnostic Medicine/Pathobiology, College of Veterinary Medicine, Kansas State University, 2002, 178 pages.

Thompson, B. M. et al., "A System of Efficient, Cost-Effective, and Customizable Vaccines for Use with Multiple Vaccine Candidates," Oct. 2010 poster presentation, 1 page.

Thompson, B. M., et al., "Assembly of the BclB Glycoprotein into the Exosporium and Evidence for its Role in the Formation of the Exosporium 'cap' Structure in Bacillus anthracis," Molecular Microbiology, Dec. 2012, pp. 1073-1084, vol. 86, No. 5.

Thompson, B. M., et al., "Localization and Assembly of the Novel Exosporium Protein BetA of Bacillus anthracis," Journal of Bacteriology, 2011, pp. 5098-5104, vol. 193, No. 19.

Thompson, B. M., et al., "Targeting of the BclA and BclB Proteins to the Bacillus anthracis Spore Surface," Molecular Microbiology, 2008, pp. 421-434, vol. 70, No. 2.

Thompson, B. M., et al., "The BclB Glycoprotein of Bacillus anthracis is Involved in Exosporium Integrity," Journal of Bacteriology, 2007, pp. 6704-6713, vol. 189, No. 18.

Thompson, B. M., et al., "The Co-Dependence of BxpB/ExsFA and BclA for Proper Incorporation into the Exosporium of Bacillus anthracis," Molecular Microbiology, 2011, pp. 799-813, vol. 79, No. 3.

(56) References Cited

OTHER PUBLICATIONS

Thompson, B. M., "Amino-Terminal Sequences of the Bacillus anthracis Exosporium Proteins BclA and BclB Important for Localization and Attachment to the Spore Surface," A Thesis presented to the Faculty of the Graduate School at the University of Missouri-Columbia, Aug. 2008, 165 pages.
Timmusk, S., et al., "The Plant-Growth-Promoting Rhizobacterium Paenibacillus polymyxa Induces Changes in *Arabidopsis thaliana* Gene Expression: A Possible Connection Between Biotic and Abiotic Stress Responses," Molecular Plant-Microbe Interactions, Nov. 1999, pp. 951-959, vol. 12, No. 11.
Timmusk, S., et al., "Paenibacillus polymyxa Invades Plant Roots and Forms Biofilms," Applied and Environmental Microbiology, Nov. 2005, pp. 7292-7300, vol. 71, No. 11.
Trivedi, P., et al., "Plant Growth Promotion Abilities and Formulation of Bacillus megaterium Strain B 388 (MTCC6521) Isolated from a Temperate Himalayan Location," Indian Journal of Microbiology, 2008, pp. 342-347, vol. 48, No. 3.
Vendan, R. T., et al., "Diversity of Endophytic Bacteria in Ginseng and Their Potential for Plant Growth Promotion," Journal of Microbiology, 2010, pp. 559-565, vol. 48, No. 5.
Von Der Weid, I., et al., "Diversity of Paenibacillus polymyxa Strains Isolated from the Rhizosphere of Maize Planted in Cerrado Soil," Research in Microbiology, Jun. 2000, pp. 369-381, vol. 151, No. 5.
Walker, R., et al., "Colonization of the Developing Rhizosphere of Sugar Beet Seedlings by Potential Biocontrol Agents Applied as Seed Treatments," Journal of Applied Microbiology, 2002, pp. 228-237, vol. 92, No. 2.
Waller, L. N., et al., "Identification of a Second Collagen-Like Glycoprotein Produced by Bacillus anthracis and Demonstration of Associated Spore-Specific Sugars," Journal of Bacteriology, Jul. 2005, pp. 4592-4597, vol. 187, No. 13.
Wang, X., et al., "PLD: Phospholipase Ds in Plant Signaling," Springer, Phospholipases in Plant Signaling, Signaling and Communication in Plants 20, Springer-Verlag Berlin Heidelberg 2014.
Yadav, S., et al., "Diversity and Phylogeny of Plant Growth-Promoting Bacilli from Moderately Acidic Soil," Journal of Basic Microbiology, Feb. 2011, pp. 98-106, vol. 51, No. 1.
Yegorenkova, I. V., et al., "Paenibacillus polymyxa Rhizobacteria and Their Synthesized Exoglycans in Interaction With Wheat Roots: Colonization and Root Hair Deformation," Current Microbiology, 2013, pp. 481-486, vol. 66, No. 5.
Zeigler, D. R., "Bacillus thuringiensis and Bacillus cereus," Bacillus Genetic Stock Center Catalog of Strains, 1999, Seventh Edition, vol. 2, 58 pages.
Zhou, Z., et al., "Immunogenicity of Recombinant Bacillus subtilis Spores Expressing Clonorchis sinensis Tegumental Protein," Parasitology Research, 2008, pp. 293-297, vol. 102, Issue 2.
Zhou, Z., et al., "Oral Administration of a Bacillus subtilis Spore-Based Vaccine Expressing Clonorchis sinensis Tegumental Protein 22.3 kDa Confers Protection Against Clonorchis sinensis," Vaccine, 2008, pp. 1817-1825, vol. 26, Issue 15.
Zou, C., et al., "Bacillus megaterium Strain XTBG34 Promotes Plant Growth by Producing 2-pentylfuran," Journal of Microbiology, Aug. 2010, pp. 460-466, vol. 48, No. 4.
Diaz, K., et al., "Root-Promoting Rhizobacteria in Eucalyptus globulus Cuttings," World Journal of Microbiology and Biotechnology, 2009, pp. 867-873, vol. 25.
Egorov, M. A., et al., "Growth Stimulating Effect of a Bacilus megaterium Strain in the Greenhouse Experiment," Vestnik of Altay State Agricultural University, 2012, pp. 46-49, vol. 89, No. 3.
Frankel, A. E., et al., "Characterization of Diphtheria Fusion Proteins Targeted to the Human Interleukin-3 Receptor," Protein Engineering, 2000, pp. 575-581, vol. 13, No. 8.
GenBank Accession No. JX047442.1, "*Bacillus* sp. SDT11 16S ribosomal RNA gene, Partial Sequence," accessed from NCBI website at <http://www.ncbi.nlm.nih.gov/nuccore/JX047442.1> on Jul. 10, 2012, 1 page.
Pakula, A. A., et al., "Genetic Analysis of Protein Stability and Function," Annual Review of Genetics, 1989, pp. 289-310, vol. 23 (Abstract Only).
Siddikee, Md. A., et al., "Regulation of Ethylene Biosynthesis Under Salt Stress in Red Pepper (*Capsicum annuum* L.) by 1-Aminocyclopropane-1-Carboxylic Acid (ACC) Deaminase-Producing Halotolerant Bacteria," Journal of Plant Growth Regulation, 2012, pp. 265-272, vol. 31, Issue 2.
U.S. Appl. No. 17/932,994, filed Sep. 16, 2022, Thompson et al.
Jetiyanon et al., Film coating of seeds with Bacillus cereus RS87 spores for early plant growth enhancement, Can. J. Microbiol. 54:861-867, 2008.
Henriques and Moran, Structure, assembly, and function of the spore surface layers, Annu. Rev. Microbiol. 61:555-88, 2007.
Shah et al., Isolation and characterization of ACC deaminase genes from two different plant growth-promoting rhizobacteria, Can. J. Microbiol. 44:833-843, 1998.
Supplementary Partial European Search Report regarding European App. No. 18858441, dated Jun. 28, 2021.
Geng et al., A novel serine protease, Sep1, from Bacillus firmus DS-1 has nematicidal activity and degrades multiple intestinal-associated nematode proteins, Scientific Reports 6(1): 2016.
UniProt Accession No. W7KRH1, dated Apr. 16, 2014.
UniProt Accession No. A0A380XNG8, dated Nov. 7, 2018.
U.S. Appl. No. 17/459,019, filed Aug. 27, 2021, Thompson et al.
U.S. Appl. No. 17/459,031, filed Aug. 27, 2021, Thompson et al.
U.S. Appl. No. 15/965,034, filed Apr. 27, 2018.
U.S. Appl. No. 16/508,524, filed Jul. 11, 2019.
U.S. Appl. No. 16/785,870, filed Feb. 10, 2020.
U.S. Appl. No. 16/563,086, filed Sep. 6, 2019.
U.S. Appl. No. 15/511,839, filed Mar. 16, 2017.
U.S. Appl. No. 16/935,020, filed Jul. 21, 2020.
U.S. Appl. No. 16/857,448, filed Apr. 24, 2020.
U.S. Appl. No. 15/511,835, filed Mar. 16, 2017.
U.S. Appl. No. 15/511,864, filed Mar. 16, 2017.
U.S. Appl. No. 16/566,156, filed Sep. 10, 2019.
U.S. Appl. No. 15/460,468, filed Mar. 16, 2017.
U.S. Appl. No. 15/461,188, filed Mar. 16, 2017.
U.S. Appl. No. 16/486,300, filed Aug. 15, 2019.
U.S. Appl. No. 16/749,576, filed Jan. 22, 2020.
U.S. Appl. No. 16/822,279, filed Mar. 18, 2020.
Takekawa, et al. "Proteases involved in generation of beta- and alpha-amylases from a large amylase precursor in Bacillus polymyxa", Journal of Bacteriology 173 (21), 6820-6825, (1991).
Barbe et al., From a consortium sequence to a unified sequence: the Bacillus subtilis 168 reference genome a decade later, Microbiology 155(6):1758-1775, 2009.
Bressuire-Isoard et al., Sporulation temperature reveals a requirement for CotE in the assembly of both the coat and the exosporium layers of *Bacillus cereus* spores, Applied and Environmental Microbiology 82(1):232-243, 2016.
GenBank Accession No. NP_389608, dated Feb. 12, 2021.
Wang, W., et al., "Comparative Proteomic Analysis of Rice Seedlings in Response to Inoculation with Bacillus cereus," Letters in Applied Microbiology, 2012, pp. 208-215, vol. 56, Issue 3.
Fan, L., et al., "Antisense Suppression of Phospholipase D(alpha) Retards Abscisic Acid- and Ethylene-Promoted Senescence of Postharvest *Arabidopsis* Leaves," The Plant Cell, Dec. 1997, pp. 2183-2196, vol. 9.
Glass, M., et al., "Endo-(beta)-1,4-Glucanases Impact Plant Cell Wall Development by Influencing Cellulose Crystallization," Journal of Integrative Plant Biology, Apr. 2015, pp. 396-410, vol. 57, Issue 4.
Hong, Y., et al., "Phospholipase D(alpha)3 Is Involved in the Hyperormotic Response in *Arabidopsis*," The Plant Cell, Mar. 2008, pp. 803-816, vol. 20.
Li, M., et al., "Overexpression of Patatin-Related Phospholipase AIII(delta) Altered Plant Growth and Increased Seed Oil Content in Camelina," Plant Biotechnology Journal, 2015, pp. 766-778, vol. 13.
Shani, Z., et al., "Growth Enhancement of Transgenic Poplar Plants by Overexpression of *Arabidopsis thaliana* Endo-1,4-beta-Glucanase (cel1)," Molecular Breeding, 2004, pp. 321-330, vol. 14.

(56) References Cited

OTHER PUBLICATIONS

Zhuang, X., et al., "New Advances in Plant Growth-Promoting Rhizobacteria for Bioremediation," Environmental International, 2007, pp. 406-413, vol. 33.
Nissinen, R., et al., "*Clavibacter michiganensis* subsp. sepedonicus Elicits A Hypersensitive Response in Tobacco and Secretes Hypersensitive Response-Inducing Protein(s)," Bacteriology, 1997, pp. 678-684, vol. 87, No. 7.
Priest, F. G., et al., "Population Structure and Evolution of the Bacillus cereus Group," Journal of Bacteriology, Dec. 2004, pp. 7959-7970, vol. 186, No. 23.
Mikayama, T., et al., "Molecular Cloning and Functional Expression of a cDNA Encoding Glycosylation-Inhibiting Factor," Proceeding of the National Academy of Science of the United States of America, Nov. 1993, pp. 10056-10060, vol. 90.
Rudinger, J., "Characteristics of the Amino Acids as Components of a Peptide Hormone Sequence," Peptide Hormones, Biology Council, Jun. 1976, pp. 5-7.
UniProtKB Accession No. P23903.1, Glucan endo-1,3-beta-glucosidase A1, 1991, 2 pages.
UniProtKB Accession No. O52864, Phosphatidyl-degrading Phospholipase C, 1998, 1 page.
Sadowski, M. I., et al., "The Sequence-Structure Relationship and Protein Function Prediction," Current Opinion in Structural Biology, 2009, pp. 357-362, vol. 19, No. 3.
Seffernick, J. L., et al., "Melamine Deaminase and Atrazine Chlorohydrolase: 98 Percent Identical but Functionally Different," Journal of Bacteriology, Apr. 2001, pp. 2405-2410, vol. 183, No. 8.
Sloma, A., et al., "Cloning and Characterization of the Gene for an Additional Extracellular Serine Protease of Bacillus subtilis," Journal of Bacteriology, Nov. 1991, pp. 6889-6895, vol. 173, No. 21.
Sousa, S., et al., "The ARO4 Gene of *Candida albicans* Encodes A Tyrosine-Sensitive DAHP Synthase: Evolution, Functional Conservation and Phenotype of Aro3p-, Aro4p-Deficient Mutants," Microbiology, 2002, pp. 1291-1303, vol. 148.
Tang, S., et al., "Identification of Dehalobacter Reductive Dehalogenases that Catalyse Dechlorination of Chloroform, 1, 1, 1-Trichloroethane and 1,1-Dichloroethane," Philosophical Transactions of The Royal Society, 2013, pp. 1-10, vol. 368, No. 1616.
Thallinger, B., et al., "Antimicrobial Enzymes: An Emerging Strategy to Fight Microbes and Microbial Biofilms," Biotechnology Journal, 2013, pp. 97-109, vol. 8, No. 1.
Valbuzzi, A., et al., "A Novel Member of the Subtilisin-like Protease Family from Bacillus subtilis," Microbiology, 1999, pp. 3121-3127, vol. 145, Part 11.
Peng, Q., et al., "The Regulation of Exosporium-Related Genes in Bacillus thuringiensis," Scientific Reports, 2016, pp. 1-12, vol. 6, No. 19005.
Tian, W., et al., "How Well is Enzyme Function Conserved as a Function of Pairwise Sequence Identity?," Journal of Molecular Biology, 2003, pp. 863-882, vol. 333, No. 4.
Dunne, C., et al., "Overproduction of an Inducible Extracellular Serine Protease Improves Biological Control of Pythium ultimum by Stenotrophomonas maltophilia Strain W81," Microbiology, 2000, pp. 2069-2078, vol. 146, Part 8.
Khan, N., et al., "Antifungal Activity of *Bacillus* Species Against Fusarium and Analysis of the Potential Mechanisms Used in Biocontrol," Frontiers in Microbiology, Oct. 2018, pp. 1-12, vol. 9, Article 2363.
Van Pouderoyen, G., et al., "Structural Insights Into the Processivity of Endopolygalacturonase I from Aspergillus niger," FEBS Letters, 2003, pp. 462-466, vol. 554, No. 3.
Yen, Y.-H., et al., "An Antifungal Protease Produced by Pseudomonas aeruginosa M-1001 with Shrimp and Crab Shell Powder as a Carbon Source," Enzyme and Microbial Technology, 2006, pp. 311-317, vol. 39.
Hachisuka, Y., et al., "Exosporia and Appendages of Spores of Bacillus Species," Microbiology and Immunology, 1984, pp. 619-624, vol. 28, No. 5.
Bailey-Smith, K., et al., "The ExsA Protein of Bacillus cereus Is Required for Assembly of Coat and Exosporium onto the Spore Surface," Journal of Bacteriology, Jun. 2005, pp. 3800-3806, vol. 187, No. 11.
International Search Report and Written Opinion issued for PCT/US2018/051995 dated Jan. 28, 2019, 14 pages.
Kaufman, C. A., et al., "Lead Bioaccessibility in Food Web Intermediates and the Influence on Ecological Risk Characterization," Environmental Science & Technology, 2007, pp. 5902-5907, vol. 41, No. 16.
Martinez-Haro, M., et al., "Avian Digestive Tract Simulation to Study the Effect of Grit Geochemistry and Food on Pb Shot Bioaccessibility," Environmental Science & Technology, 2009, pp. 9480-9486, vol. 43, No. 24.
Ariza, A., et al., "Structure and Activity of Paenibacillus polymyxa Xyloglucanase From Glycoside Hydrolase Family 44," The Journal of Biological Chemistry, 2011, pp. 33890-33900, vol. 286, No. 39.
Bergman, N. H., et al., "Transcriptional Profiling of the Bacillus anthracis Life Cycle in Vitro and an Implied Model for Regulation of Spore Formation," Journal of Bacteriology, Sep. 2006, pp. 6092-6100, vol. 188, No. 17.
Patrignani, A., et al., "Canopeo: A Powerful New Tool for Measuring Fractional Green Canopy Cover," Agronomy Journal, 2015, pp. 2312-2320, vol. 107, Issue 6.
Bewley, J. D., "Breaking Down the Walls—A Role for Endo-beta-mannanase in Release from Seed Dormancy?," Trends in Plant Science, Dec. 1997, pp. S1360-S1385, vol. 2, No. 12.
Leviatov, S., et al., "Involvement of Endomannanase in the Control of Tomato Seed Germination Under Low Temperature Conditions," Annals of Botany, 1995, pp. 1-6, vol. 76.
Partial Supplementary European Search Report issued for EP17767505.5 dated Feb. 26, 2020, 5 pages.
Rodriguez-Gacio, M. C., et a., "Softening-up Mannan-rich Cell Walls," Journal of Experimental Botany, 2012, pp. 3975-3988, vol. 63, No. 11.
Yang, P., et al., "A Novel Beta-Mannanase with High Specific Activity from Bacillus circulans CGMCC1554: Gene Cloning, Expression and Enzymatic Characterization," Applied Biochemistry and Biotechnology, 2009, pp. 85-94, vol. 159, No. 1.
International Search Report and Written Opinion issued for PCT/US2017/022662 dated Jun. 5, 2017, 11 pages.
Li, Z., et al., "A Colorimetric Assay of 1-aminocyclopropane-1-carboxylate (ACC) Based on Ninhydrin Reaction for Rapid Screening of Bacteria Containing ACC Deaminase," Letters in Applied Microbiology, 2011, pp. 178-185, vol. 53.
Lin, Z., et al., "Recent Advances in Ethylene Research," Journal of Experimental Botany, 2009, pp. 3311-3336, vol. 60, Issue 12.
Liu, W., et al., "THIS1 is A Putative Lipase that Regulates Tillering, Plant Height, and Spikelet Fertility in Rice," Journal of Experimental Botany, 2013, pp. 1-14, vol. 64, No. 14.
Brandt Consolidated, Inc., Brandt Steric P DS, Water Soluble Fertilizer Product Description, 2013, 1 page.
Murashige, T., et al., "A Revised Medium for Rapid Growth and Bioassays with Tobacco Tissue Cultures," Physiologia Plantarum, 1962, pp. 473-497, vol. 15.
UniProtKB Accession No. C4PKL1, Purple Acid Phosphatase, 2009, 1 page.
Vasil, V., et al., "Herbicide Resistant Fertile Transgenic Wheat Plants Obtained by Microprojectile Bombardment of Regenerable Embryogenic Callus," Bio/Technology, Jun. 1992, pp. 667-674, vol. 10.
Johnson M. J., et al., "ExsY and CotY are Required for the Correct Assembly of the Exosporium and Spore Coat of Bacillus cereus," Journal of Bacteriology, 2006, pp. 7905-7913, vol. 188, No. 22.
Karakurt, H., et al., "Effects of indol-3-butyric acid (IBA), Plant Growth Promoting Rhizobacteria (PGPR) and Carbohydrates on Rooting of Hardwood Cutting of MM106 Apple Rootstock," African Journal of Agricultural Research, Feb. 2009, pp. 060-064, vol. 4, No. 2.
Karigar, C., et al., "Role of Microbial Enzymes in the Bioremediation of Pollutants: A Review," SAGE-Hindawi Access to Research Enzyme Research, vol. 2011, Article ID 805187, 11 pages.

(56) References Cited

OTHER PUBLICATIONS

Khan, Z., et al., "A Plant Growth Promoting Rhizobacterium, Paenibacillus polymyxa Strain GBR-1, Suppresses Root-Knot Nematode," Bioresource Technology, May 2008, pp. 3016-3023, vol. 99, No. 8.

Kim, J. F., et al., "Genome Sequence of the Polymyxin-Producing Plant-Probiotic Rhizobacterium Paenibacillus polymyxa E681," Journal of Bacteriology, 2010, pp. 6103-6104, vol. 192, No. 22.

Kim, J. H., et al., "Bacterial Surface Display of GFP(uv) on Bacillus subtilis Spores," Journal of Microbiology and Biotechnology, Apr. 2007, pp. 677-680, vol. 17, No. 4.

Kim, J. H., et al., "Spore-Displayed Streptavidin: A Live Diagnostic Tool in Biotechnology," Biochemical and Biophysical Research Communications, May 2005, pp. 210-214, vol. 331, No. 1.

Kishore, G. K., et al., "Phylloplane Bacteria Increase Seedling Emergence, Growth and Yield of Field-Grown Groundnut (*Arachis hypogaea* L.)," Letters in Applied Microbiology, 2005, pp. 260-268, vol. 40, No. 4.

Kong, Z., et al., "Effects of 1-Aminocyclopropane-1-Carboxylate (ACC) Deaminase-Overproducing Sinorhizobium meliloti on Plant Growth and Copper Tolerance of Medicago lupulina," Plant and Soil, Jun. 2015, pp. 383-398, vol. 391, Issue 1.

Lamsal, K., et al., "Application of Rhizobacteria for Plant Growth Promotion Effect and Biocontrol of Anthracnose Caused by Colletotrichum acutatum on Pepper," Mycobiology, Dec. 2012, pp. 244-251, vol. 40, No. 4.

Lee, S., et al., "Growth Promotion of Xanthium italicum by Application of Rhizobacterial Isolates of Bacillus aryabhattai in Microcosm Soil," Journal of Microbiology, Feb. 2012, pp. 45-49, vol. 50, No. 1.

Leite, H. A., et al., "Bacillus subtilis and Enterobacter cloacae Endophytes from Healthy *Theobroma cacao* L. Trees can Systemically Colonize Seedlings and Promote Growth," Applied Microbiology and Biotechnology, Dec. 2012, pp. 2639-2651, vol. 97, No. 6.

Leski, T. A., et al., "Identification and Classification of bcl Genes and Proteins of Bacillus cereus Group Organisms and Their Application in Bacillus anthracis Detection and Fingerprinting," Applied and Environmental Microbiology, Nov. 2009, pp. 7163-7172, vol. 75, No. 22.

Leveau, J. H. J., et al., "Utilization of the Plant Hormone Indole-3-Acetic Acid for Growth by Pseydomonas putida Strain 1290," Applied and Environmental Microbiology, May 2005, pp. 2365-2371, vol. 71, No. 5.

Li, J., et al., "An ACC Deaminase Minus Mutant of Enterobacter cloacae UW4 No Longer Promotes Root Elongation," Current Microbiology, Aug. 2000, pp. 101-105, vol. 41, No. 2.

Li, W., et al., "Cloning of the Thermostable Cellulose Gene from the Newly Isolated Bacillus subtillus and its Expression in *Excherichia coli*," Molecular Biotechnology, 2008, pp. 195-201, vol. 40, No. 2.

Liu, J. L., et al., "Effects of Two Plant Growth-Promoting Rhizobacteria Containing 1-Aminocyclopropane-1-Carboxylate Deaminase on Oat Growth in Petroleum Contaminated Soil," International Journal of Environmental Science and Technology, Dec. 2015, pp. 3887-3894, vol. 12, Issue 12.

Liu, X., et al., "Colonization of Maize and Rice Plants by Strain Bacillus megaterium C4," Current Microbiology, 2006, pp. 186-190, vol. 52, No. 3.

Liu, Y., et al., "Study on Mechanisms of Colonization of Nitrogen-Fixing PGPB, Klebsiella pneumoniae NG14 on the Root Surface of Rice and the Formation of Biofilm," Current Microbiology, 2011, pp. 1113-1122, vol. 62, No. 4.

Lopez-Bucio, J., et al., "Bacillus megaterium Rhizobacteria Promote Growth and Alter Root-System Architecture Through an Auxin- and Ethylene-Independent Signaling Mechanism in *Arabidopsis thaliana*," Molecular Plant-Microbe Interactions, Feb. 2007, pp. 207-217, vol. 20, No. 2.

Luiz, W. B., et al., "Boosting Systemic and Secreted Antibody Responses in Mice Orally Immunized with Recombinant Bacillus subtilis Strains Following Parenteral Priming with a DNA Vaccine Encoding the Enterotoxigenic *Escherichia coli* (ETEC) CFA/I fimbriae B Subunit," Vaccine, 2008, pp. 3998-4005, vol. 26, No. 32.

Madmony, A., et al., "Enterobacter cloacae, An Obligatory Endophyte of Pollen Grains of Mediterranean Pines," Folia Microbiologica (Praha), 2005, pp. 209-216, vol. 50, No. 3.

Maes, M., et al., "Experiences and Perspectives for the Use of A Paenibacillus Strain as a Plant Protectant," Communications in Agricultural and Applied Biological Sciences, 2003, pp. 457-462, vol. 68, No. 4, Part B.

Marulanda, A., et al., "Regulation of Plasma Membrane Aquaporins by Inoculation with a Bacillus megaterium Strain in Maize (*Zea mays* L.) Plants Under Unstressed and Salt-Stressed Conditions," Planta, 2010, pp. 533-543, vol. 232, No. 2.

Mauriello, E. M., et al., "Display of Heterologous Antigens on the Bacillus subtilis Spore Coat Using CotC as a Fusion Partner," Vaccine, Mar. 2004, pp. 1177-1187, vol. 22, Nos. 9-10.

Medie, F. M., "Genome Analyses Highlight the Different Biological Roles of Cellulases," Nature Reviews Microbiology, Mar. 2012, pp. 227-234, vol. 10.

Meldau, D. G., et al., "A Native Plant Growth Promoting Bacterium, *Bacillus* sp.B55, Rescues Growth Performance of an Ethylene-Insensitive Plant Genotype in Nature," Frontiers in Plant Science, Jun. 2012, pp. 1-13, vol. 3, Article 112.

Mercado, J. A., et al., "Expression of the beta-1,3-glucanase Gene bgn13.1 from Trichoderma harzianum in Strawberry Increases Tolerance to Crown Rot Diseases but Interferes with Plant Growth," Transgenic Research, Dec. 2015, pp. 979-989, vol. 24, Issue 6.

Negri, A., et al., "Expression and Display of Clostridium difficile Protein FliD on the Surface of Bacillus subtilis Spores," Journal of Medical Microbiology, 2013, pp. 1379-1385, vol. 62.

Ngamau, C., "Endophytic Bacteria Associated with Bananas (*Musi* spp.) in Kenya and Their Potential as Biological Fertilizers," A thesis submitted in fulfillment for the degree of Doctor of Philosophy in Plant Science in the Jomo Kenyatta University of Agriculture and Technology, 2013, 191 pages.

Oh, T., et al., "Expression of Aspergillus nidulans phy Gene in Nicotiana benthamiana Produces Active Phytase with Broad Specificities," International Journal of Molecular Sciences, 2014, pp. 15571-15591, vol. 15, No. 9.

Ortiz-Castro, R., et al., "Plant Growth Promotion by Bacillus megaterium Involves Cytokinin Signaling," Plant Signaling & Behavior, 2008, pp. 263-265, vol. 3, Issue 4.

Paccez, J. D., et al., "Evaluation of Different Promoter Sequences and Antigen Sorting Signals on the Immunogenicity of Bacillus subtilis Vaccine Vehicles," Vaccine, 2007, pp. 4671-4680, vol. 25, No. 24.

Paccez, J. D., et al., "Stable Episomal Expression System Under Control of a Stress Inducible Promoter Enhances the Immunogenicity of Bacillus subtilis as a Vector for Antigen Delivery," Vaccine, 2006, pp. 2935-2943, vol. 24, No. 15.

Park, T. J., et al., "Spore Display Using Bacillus thuringiensis Exosporium Protein InhA," Journal of Microbiology and Biotechnology, May 2009, pp. 495-501, vol. 19, No. 5.

Park, T. J., "Surface-Display of Recombinant Proteins on Bacterial Exosporium and its Biotechnological Applications," Doctoral Thesis presented to the Department of Chemical and Biomolecular Engineering, Korea Advanced Institute of Science and Technology, 2004, 104 pages.

Peixoto, R. S., et al., "Petroleum-Degrading Enzymes: Bioremediation and New Prospects," SAGE-Hindawi Access to Research Enzyme Research, vol. 2011, Article ID 475193, 7 pages.

Penrose, D. M., et al., "Levels of ACC and Related Compounds in Exudate and Extracts of Canola Seeds Treated with ACC Deaminase-Containing Plant Growth-Promoting Bacteria," Canadian Journal of Microbiology, Apr. 2001, pp. 368-372, vol. 47, No. 4.

Pereira, C. E., et al., "Compatibility Among Fungicide Treatments on Soybean Seeds Through Film Coating and Inoculation with Bradyrhizobium Strains," Acta Scientiarum. Agronomy, Maringá, 2010, pp. 585-589, vol. 32, No. 4.

Petrov, K., et al., "High Production of 2,3-Butanediol from Glycerol by Klebsiella pneumoniae G31," Applied Microbiology and Biotechnology, 2009, pp. 659-665, vol. 84, No. 4.

(56) References Cited

OTHER PUBLICATIONS

Phi, Q. T., et al., "Assessment of Root-Associated Paenibacillus polymyxa Groups on Growth Promotion and Induced Systemic Resistance in Pepper," Journal of Microbiology and Biotechnology, Dec. 2010, pp. 1605-1613, vol. 20, No. 12.

Phitsuwan, P., et al., "Present and Potential Applications of Cellulases in Agriculture, Biotechnology, and Bioenergy," Folia Microbiologica, 2013, pp. 163-176, vol. 58, No. 2.

Pilar-Izquierdo, M. C., et al., "Barley Seed Coating with Free and Immobilized Alkaline Phosphatase to Improve P Uptake and Plant Growth," Journal of Agricultural Science, 2012, pp. 691-701, vol. 150, Issue 6.

Ping, R., et al., "Effect of Cellulase on Germination of Pinus tabulaeformis Seeds and Grow Seedlings," Journal of Northwest Forestry College, 2005, pp. 78-79, vol. 20, No. 1 (Abstract).

Prusty, R., et al., "The Plant Hormone Indoleacetic Acid Induces Invasive Growth in *Saccharomyces cerevisiae*," Proceedings of the National Academy of Sciences of the United States of America, Mar. 2004, pp. 4153-4157, vol. 101, No. 12.

Raddadi, N., et al., "Screening of Plant Growth Promoting Traits of Bacillus thuringiensis," Annals of Microbiology, 2008, pp. 47-52, vol. 58, No. 1.

Rasco, D. A., et al., UniProt KB database entry Q738B1-Q7381_BACC1, Jul. 5, 2004, 6 pages (referencing Rasco, D. A., et al., "The Genome Sequence of Bacillus cereus ATCC 10987 Reveals Metabolic Adaptations and a Large Plasmid Related to Bacillus anthracis pX01.," Nucleic Acids Research, 2004, pp. 977-988, vol. 32).

Rajendran, G., et al., "Enhanced Growth and Nodulation of Pigeon Pea by Co-Inoculation of Bacillus Strains with *Rhizobium* spp.," Bioresource Technology, 2007, pp. 4544-4550, vol. 99, No. 11.

Rajkumar, M., et al., "Effects of Inoculation of Plant-Growth Promoting Bacteria on Ni Uptake by Indian Mustard," Bioresource Technology, 2008, pp. 3491-3498, vol. 99, No. 9.

Rao, M. A., et al., "Role of Enzymes in the Remediation of Polluted Environments," Journal of Soil Science and Plant Nutrition, 2010, 21 pages, vol. 10, No. 3.

U.S. Appl. No. 17/852,607, filed Jun. 29, 2022, Curtis, et al.

Ahemad, M., et al., "Mechanisms and Applications of Plant Growth Promoting Rhizobacteria: Current Perspective," Journal of King Saud University—Science, 2014, pp. 1-20, vol. 26.

Anand, R., et al., "N2-Fixation and Seedling Growth Promotion of Lodgepole Pine by Endophytic Paenibacillus polymyxa," Microbial Ecology, 2013, pp. 369-374, vol. 66, No. 2.

Bae, C., et al., Multiple Classes of Immune Related Ptoteases Associated with the Cell Death Response in Pepper Plants, PLOS One, 2013, vol. 8, No. 5, e63533.

Bent, E., et al., "Alterations in Plant Growth and in Root Hormone Levels of Lodgepole Pines Inoculated with Rhizobacteria," Canadian Journal of Microbiology, Sep. 2001, pp. 793-800, vol. 47, No. 9.

Berlemont, R., et al., "Phylogenetic Distribution of Potential Cellulases in Bacteria," Applied and Environmental Microbiology, Mar. 2013, pp. 1545-1554, vol. 79, No. 5.

Boydston, J. A., et al., "The ExsY Protein is Required for Complete Formation of the Exosporium of Bacillus anthracis," Journal of Bacteriology, 2006, pp. 7440-7448, vol. 188, No. 21.

Chakraborty, U., et al., "Plant Growth Promotion and Induction of Resistance in Camellia sinensis by Bacillus megaterium," Journal of Basic Microbiology, 2006, pp. 186-195, vol. 46, No. 3.

Chapman, K. D., "Phospholipase Activity During Plant Growth and Development and in Response to Environmental Stress," Trends in Plant Science, Nov. 1998, pp. 419-426, vol. 3, Issue 11.

Choudhary, D. K., et al., "Interactions of *Bacillus* spp. and Plants—With Special Reference to Induced Systemic Resistance (ISR)," Microbiological Research, 2009, pp. 493-513, vol. 164.

Ciabattini, A., et al., "Oral Priming of Mice by Recombinant Spores of Bacillus subtilis," Vaccine, Oct. 2004, pp. 4139-4143, vol. 22, Nos. 31-32.

Corbineau, F. and Côme, D., "Improvement of Germination of Terminalia Ivorensis Seeds," Forest Genetic Resources Information No. 21, http://www.fao.org/docrep/006/v3030e/V3030E10.htm, 7 pages.

Da Mota, F. F., et al., "Auxin Production and Detection of the Gene Coding for the Auxin Efflux Carrier (AEC) Protein in Paenibacillus polymyxa," Journal of Microbiology, Jun. 2008, pp. 257-264, vol. 46, No. 3.

De Freitas, J. R., et al., "Phosphate-solubilizing Rhizobacteria Enhance the Growth and Yield but not Phosphorus Uptake of Canola (*Brassica napus* L.)," Biology and Fertility of Soils, May 1997, pp. 358-364, vol. 24, Issue 4.

Ding, Y., et al., "Isolation and Identification of Nitrogen-Fixing Bacilli from Plant Rhizospheres in Beijing Region," Journal of Applied Microbiology, 2005, pp. 1271-1281, vol. 99, No. 5.

Dong, Y.-H., et al., "Identification of Quorum-Quenching N-Acyl Homoserine Lactonases from *Bacillus* Species," Applied and Environmental Microbiology, 2002, pp. 1754-1759, vol. 68, No. 4.

Doronina, N. V., et al., "Emended Description of Paracoccus kondratievae," International Journal of Systematic and Evolutionary Microbiology, Mar. 2002, pp. 679-682, vol. 52, Part 2.

Dourado, M., et al., "Biotechnological and Agronomic Potential of Endophytic Pink-Pigmented Methylotrophic *Methylobacterium* spp.," BioMed Research International, vol. 2015, Article ID 909016, 19 pages.

Dowd, P. E., et al., "The Emerging Roles of Phospholipase C in Plant Growth and Development," Lipid Signaling in Plants, 2010, pp. 23-37, vol. 16.

Duc Le H., et al., "Bacterial Spores as Vaccine Vehicles," Infection and Immunity, May 2003, pp. 2810-2818, vol. 71, No. 5.

Duc, Le H., et al., "Immunization Against Anthrax Using Bacillus subtilis Spores Expressing the Anthrax Protective Antigen," Vaccine, Jan. 2007, pp. 346-355, vol. 25, No. 2.

English, M. M., et al., "Overexpression of hns in the Plant Growth-Promoting Bacterium Enterobacter cloacae UW5 Increases Root Colonization," Journal of Applied Microbiology, 2009, pp. 2180-2190, vol. 108, Issue 6.

Erturk, Y., et al., "Effects of Plant Growth Promoting Rhizobacteria (PGPR) on Rooting and Root Growth of Kiwifruit (*Actinidia deliciosa*) Stem Cuttings," Biological Research, 2010, pp. 91-98, vol. 43, No. 1.

Faria, D. C., et al., "Endophytic Bacteria Isolated from Orchid and Their Potential to Promote Plant Growth," World Journal of Microbiology & Biotechnology, 2013, pp. 217-221, vol. 29, No. 2.

Feng, F. et al., "Display of Human Proinsulin on the Bacillus subtilis Spore Surface for Oral Administration," Current Microbiology, Jul. 2013, pp. 1-8, vol. 67, Issue 1.

Forage, R. G., et al., "Glycerol Fermentation in Klebsiella pneumoniae: Functions of the Coenzyme B12-Dependent Glycerol and Diol Dehydratases," Journal of Bacteriology, Feb. 1982, pp. 413-419, vol. 149, No. 2.

Gamalero, E., et al., "Bacterial Modulation of Plant Ethylene Levels," Plant Physiology, Sep. 2015, pp. 13-22, vol. 169, Issue 1.

Glick, B. R., "Modulation of Plant Ethylene Levels by the Bacterial Enzyme ACC Deaminase," FEMS Microbiology Letters, Oct. 2005, pp. 1-7, vol. 251, Issue 1.

Gnanaraj, M., et al. "Isolation and Gene Expression Analysis of Phospholipase C in Response to Abiotic Stresses from *Vigna radiata* (L.) Wilczek," Indian Journal of Experimental Biology, Jun. 2015, pp. 335-341, vol. 53.

Goldberg, L. J., et al., "A Bacterial Spore Demonstrating Rapid Larvicidal Activity Against Anopheles Sergentii, Uranotaenia Unguiculata, Culex Univitattus, Aedes Aegypti and Culex Pipiens," Mosquito News, Sep. 1977, pp. 355-358, vol. 37, No. 3.

Guerchicoff, A., et al., "Identification and Characterization of A Previously Undescribed cyt Gene in Bacillus thuringiensis subsp. israelensis," Applied and Environmental Microbiology, Jul. 1997, pp. 2716-2721, vol. 63, No. 7.

Gujar, P. D., et al., "Effect of Phytase from Aspergillus niger on Plant Growth and Mineral Assimilation in Wheat (*Triticum aestivum* Linn.) and its Potential for Use as a Soil Amendment," Journal of the Science of Food and Agriculture, 2013, pp. 2242-2247, vol. 93, Issue 9.

(56) References Cited

OTHER PUBLICATIONS

Hafeez, F. Y., et al., "PGPR: Versatile Tool to Combat Soil Borne Pathogens and Improve Plant Health," Aspects of Applied Biology, 2011, pp. 241-245, vol. 106.

Haggag, W. M., et al., "Colonization of Peanut Roots by Biofilm-Forming Paenibacillus polymyxa Initiates Biocontrol Against Crown Rot Disease," Journal of Applied Microbiology, 2008, pp. 961-969, vol. 104, No. 4.

Han, W. et al., "The Application of Exogenous Cellulase to Improve Soil Fertility and Plant Growth Due to Acceleration of Straw Decomposition," Bioresource Technology, May 2010, pp. 3724-3731, vol. 101, Issue 10.

Hartati, S., et al., "Overexpression of Poplar Cellulase Accelerates Growth and Disturbs The Closing Movements of Leaves in Sengon," Plant Physiology, 2008, pp. 552-561, vol. 147, Issue 2.

Hinton, D. M., et al., "Enterobacter cloacae is an Endophytic Symbiont of Corn", Mycopathologia, 1995, pp. 117-125, vol. 129, No. 2.

Hoelscher, B., et al., "Removal of Toxic Contaminants from Polluted Soil and Water via Enzyme-Linked Bacillus Spores," Poster presented at Missouri Life Sciences Week Research Poster Session, Apr. 14, 2010.
Hong, Y. et al., "Phospholipases in Plant Response to Nitrogen and Phosphorus Availability," Springer, Phospholipases in Plant Signaling and Communication in Plants, 2013, pp. 159-180, vol. 20.
Hontzeas, N., et al., "Changes in Gene Expression in Canola Roots Induced by ACC-Deaminase-Containing Plant-Growth-Promoting Bacteria," Molecular Plant-Microbe Interactions, Aug. 2004, pp. 865-871, vol. 17, No. 8.
Howard, G., et al., "Effects of Cellulolytic Ruminol Bacteria and of Cell Extracts on Germination of *Euonymus americanus* L. Seeds," Applied and Environmental Microbiology, Jan. 1988, pp. 218-224, vol. 54, No. 1.
Idriss, E. E., et al., "Extracellular Phytase Activity of Bacillus amyloliquefaciens FZB45 Contributes to its Plant-Growth-Promoting Effect," Microbiology, 2002, pp. 2097-2109, vol. 148.
Iniguez, A. L., et al., "Nitrogen Fixation in Wheat Provided by Klebsiella pneumoniae 342," Molecular Plant-Microbe Interactions, Oct. 2004, pp. 1078-1085, vol. 17, No. 10.
Invitation to Pay Additional Fees and, Where Applicable, Protest Fees, issued for PCT/US2015/050795, dated Jan. 14, 2016, 8 pages.
International Search Report and Written Opinion issued for PCT/US2015/050795, dated Mar. 31, 2016, 17 pages.
International Search Report and Written Opinion issued for PCT/US2015/050807, dated Dec. 10, 2015, 12 pages.
Islam, M. R., et al., "Characterization of Plant Growth-Promoting Traits of Free-Living Diazotrophic Bacteria and Their Inoculation Effects on Growth and Nitrogen Uptake of Crop Plants," Journal of Microbiology and Biotechnology, Oct. 2009, pp. 1213-1222, vol. 19, No. 10.
Isticato, R., et al., "Surface Display of Recombinant Proteins on Bacillus subtilis Spores," Journal of Bacteriology, Nov. 2001, pp. 6294-6301, vol. 183, No. 21.
Iwanicki, A., et al., "A System of Vectors for Bacillus subtilis Spore Surface Display," Microbial Cell Factories, 2014, pp. 1-9, vol. 13, No. 30.
Jackson, W. T., "Effect of Pectinase and Cellulase Preparations on the Growth and Development of Root Hairs," Physiologia Plantarum, 2006 (first published in 1959), pp. 502-510, vol. 12.
Jeong, H., et al., "Draft Genome Sequence of the Paenibacillus polymyxa Type Strain (ATCC 842T), A Plant Growth-Promoting Bacterium," Journal of Bacteriology, 2011, pp. 5026-5027, vol. 193, No. 18.
Nguyen et al., Bacillus subtilis spores expressing the VP28 antigen: a potential oral treatment to protect Litopenaeus vannamei against white spot syndrome, FEMS Microbiology Letters 358(2): 202-208, 2014.
Crane et al., Bacterial Nitric Oxide Synthases, Annual Review in Biochemistry 79:445-470, 2010.
Aakre, et al. Inhibition of Bacillus cereus phospholipase C by univalent anions. The Biochemical Journal 203, 799-801, (1982).
Goldfine, et al. "Nonspecific phospholipase C of Listeria monocytogenes: activity on phospholipids in Triton X-100-mixed micelles and in biological membranes". J Bacteriol 175, 4298-4306, (1993).
Huang, et al. "Recombinant broad-range phospholipase C from Listeria monocytogenes exhibits optimal activity at acidic pH". Biochimica et Biophysica Acta (BBA)—Proteins and Proteomics 1864(6), 697-705, (2016).
Monturiol-Gross, et al. "Bacterial phospholipases C with dual activity: phosphatidylcholinesterase and sphingomyelinase". FEBS Open Bio, vol. 11(12), pp. 3262-3275, (2021).
Otnaess. "The hydrolysis of sphingomyelin by phospholipase C from Bacillus cereus". FEBS Letters 114, 202-204, (1980).
Pomerantsev, et al. "Phosphatidylcholine-specific phospholipase C and sphingomyelinase activities in bacteria of the Bacillus cereus group". Infect Immun. (2003); 71(11): 6591-606.
Tan, et al. "Cloning, overexpression, refolding, and purification of the nonspecific phospholipase C from Bacillus cereus". Protein Expr Purif 10, 365-372, (1997).
Zuckert, et al. "Modulation of enzymatic activity and biological function of Listeria monocytogenes broad-range phospholipase C by amino acid substitutions and by replacement with the Bacillus cereus ortholog". Infect Immun 66, 4823-4831, (1998).
U.S. Appl. No. 18/302,458, filed Apr. 18, 2023, Thompson, et al.
U.S. Appl. No. 18/461,008, filed Sep. 5, 2023, Curtis, et al.
U.S. Appl. No. 18/476,256, filed Sep. 27, 2023, Thompson, et al.
U.S. Appl. No. 18/476,259, filed Sep. 27, 2023, Thompson, et al.
U.S. Appl. No. 18/476,264, filed Sep. 27, 2023, Thompson, et al.
U.S. Appl. No. 18/476,270, filed Sep. 27, 2023, Thompson, et al.
Giorno, et al. "Morphogenesis of the *Bacillus anthracis* Spore". Journal of Bacteriology, Feb. 2007, vol. 189 (3), p. 691-705.
U.S. Appl. No. 18/392,771, filed Dec. 21, 2023, Thompson, et al.
U.S. Appl. No. 18/398,650, filed Dec. 28, 2023, Thompson, et al.

* cited by examiner

FIG. 1A

| | SEQ ID NO. | 20-35 %Identity | 25-35 %Identity |
|---|---|---|---|
| MSNNYSNGLNPDESLSASAFDPNLVGPTLPPIPPFTLPTG | 1 | 100% | 100% |
| MSEKYIILHGTALEPNLIGPTLPPIPPFTFPNG | 3 | 81.3% | 90.9% |
| MVKVVEGNGGKSKIKSPLNSNFKILSDLVGPTEPPVPTGMTGIT | 5 | 50.0% | 72.7% |
| MKQNDKLWLDKGIIGPENIGPTFPVLPPIHIPTG | 7 | 43.8% | 54.5% |
| MDEFLSSAALNPGSVGPTLPPMQPFQFRTG | 9 | 62.5% | 72.7% |
| MFDKNEIQKINGILQANALNPNLIGPTLPPIPPFTLPTG | 11 | 81.3% | 90.9% |
| MFDKNEMKKTNEVLQANALDPNIGPTLPPIPPFTLPTG | 13 | 81.3% | 81.8% |
| MSRKDKFNRSRMSRKDRENSPKIKSEISISPDLVGPTFPPIPSFTLPTG | 15 | 62.5% | 81.8% |
| MNEEYSILHGPALEPNLIGPTLPSIPPFTFPTG | 17 | 75.0% | 81.8% |
| MKNRDNNRKQNSLSSNFRIPPELIGPTFPPVPTGFTGIG | 19 | 50.0% | 63.6% |
| MSDKHQMKKISEVLQAHALDPNLIGPPLPPITPFTFPTG | 21 | 75.0% | 72.7% |
| MDEFLSFAALNPGSIGPTLPPVPFQFPTG | 23 | 62.5% | 72.7% |
| MDEFLSSTALNPCSIGPTLPPMQPFQFPTG | 25 | 56.2% | 63.6% |
| MKERDRQNSLNSNFRISPNLIGPTFPPVPTGFTGIG | 27 | 56.2% | 63.6% |
| VFDKNEIQKINGILQANALNPNLIGPTLPPIPPFTLPTG | 29 | 81.3% | 90.9% |
| MDEFLYFAALNPGSIGPTLPPVQPFQFPTG | 31 | 56.2% | 63.6% |
| MDSKNIGPTFPPLPSINFPTG | 33 | 43.8% | 54.5% |
| MIGPENIGPTFPILPPIYIPTG | 35 | 43.8% | 54.5% |
| MSNNNIPSPFFNNFNPELIGPTFPPIPPLTLPTG | 43 | 68.8% | 81.8% |
| MFSEKKRKDLIPDNFLSAPALDPNLIGPTFPPIPSFTLPTG | 45 | 75.0% | 72.7% |
| MTRKDKFNRSRISRRDRFNSPKIKSEILISPDLVGPTFPPIPSFTLPTG | 47 | 62.5% | 81.8% |
| MSRKDRFNSPKIKSEISISPDLVGPTFPPIPSFTLPTG | 49 | 62.5% | 81.8% |
| MKERDNKGKQHSLNSNFRIPPELIGPTFPPVPTGFTGIG | 51 | 50.0% | 63.6% |
| MRERDNKRQQHSLNPNFRISPELIGPTFPPVPTGFTGIG | 53 | 50.0% | 63.6% |
| MKNRDNKGKQQSNFRIPPELIGPTFPPVPTGFTGIG | 55 | 50.0% | 63.6% |
| MKFSKKSTVDSSIVGKRVVSKVNILRFYDARSCQDKDVDGFVDVGELFTIFRKLNMEGSVQFKAHNSI GKTYYITINEVYVFVTVLLQYSTLIGGSYVFDKNEIQKINGILQANALNPNLIGPTLPPIPPFTLPTG | 57 | 81.3% | 90.9% |

FIG. 1B

| | SEQ ID NO. | 20-35 %Identity | 25-35 %Identity |
|---|---|---|---|
| MSNNNYSNGLNPDESLSASAAFDPNLVGPTLPPIPPFTLPTG | 1 | 100% | 100% |
| MKERDKQNSLNSNFRISPNLIGPTFPPVPTGFTGIG | 59 | 56.2% | 63.6% |
| MMENKKGSKHNEFLSAKAFNPNLVGPTLPPVPSFTLPTG | 61 | 81.3% | 81.8% |
| MSNNNYSDGLNPDEFLSASAFDPNLVGPTLPPIPPFTLPTG | 63 | 100% | 100% |
| MDEFLSSAAINPNLVGPTLPPVPFTLPTG | 65 | 81.3% | 90.9% |
| MFDKNKILQANAFNSNLIGPTLPPIPPFTLPTG | 67 | 81.3% | 90.9% |
| MSDENEKKYSNELAQADFISAAAFDPSLVGPTLPPTPPFTLPTG | 69 | 87.5% | 90.9% |
| MSRKDRFNSPKIKSEISISPDLVGPTFPPIPSFTLPTG | 71 | 62.5% | 81.8% |
| MDEFLSSAAINPGSVGPTLPPMQPFQFSTG | 73 | 62.5% | 72.7% |
| MFLGGGYMERKNKWYGLNSNVNLSASSFDPNLVGPTLPPISPSVPTG | 75 | 87.5% | 90.9% |
| MDELLSSTLINPDLLGPTLPAIPPFTLPTG | 77 | 62.5% | 81.8% |
| MKNRDNNRKCNSLSSNFRIPPELIGPTFPPVPTGFTGIG | 79 | 50.0% | 63.6% |
| MVKVVEGNSGKSKIKSSLNSNFKLSSGLVGPTFPPVPTGMTGIT | 81 | 50.0% | 72.7% |
| MEGNGGKSKIKSPLNSNFKILSDLVGPTFPPVPTGMTGIT | 83 | 50.0% | 72.7% |
| MKQNDKLWLDKGIIGPENIGTFPVLPPIHIPTG | 85 | 43.8% | 54.5% |
| MNSNEKLSLNKGMVRPENIGPTFPVLPPIYIPTG | 87 | 43.8% | 54.5% |
| MKRNDNLSLNKGMIGPENIGPTFPILPPIYIPTG | 89 | 43.8% | 54.5% |
| MGKTYYITINEVYYVTVLLQYSTLIGGSYVFDKNEIQKINGILQANALNPNLIGPTLPPIPPFTLPTG | 91 | 81.3% | 90.9% |
| MKFSKKSTVDSSIVGKRVVSKVNILRFYDARSWQDKDVDGFVDVGELFTIFRKLNMEGSVQFKAHNSI GKTYYITINEVYVFVTVLLQYSTLIGGSYVFDKNEIQKINGILQANALNPNLIGPTLPPIPPFTLPTG | 93 | 81.3% | 90.9% |

FUSION PROTEINS, RECOMBINANT BACTERIA, AND EXOSPORIUM FRAGMENTS FOR PLANT HEALTH

CROSS-REFERENCE TO RELATED APPLICATIONS

The present application is a U.S. National Stage Application of PCT Application No. PCT/US2018/051995, filed Sep. 20, 2018, which claims the benefit of U.S. Provisional Application Ser. No. 62/560,876, filed Sep. 20, 2017. Each of the above-cited applications is incorporated herein by reference in its entirety.

INCORPORATION OF SEQUENCE LISTING

A sequence listing contained in the file named "GeneSequenceListing.TXT" which is 621,774 bytes (measured in MS-Windows®) and created on Mar. 17, 2020, and comprises 388 sequences, is incorporated herein by reference in its entirety.

FIELD OF THE INVENTION

The present invention relates to fusion proteins containing a targeting sequence, exosporium protein, or exosporium protein fragment that targets the fusion protein to the exosporium of a recombinant *Bacillus cereus* family member. The fusion proteins further comprise an enzyme having ACC deaminase activity, a phospholipase, a lipase, a xylanase, a xylosidase, a lactonase, a chitosanase, a protease, a glucanase, a phytase, an acid phosphatase, a pectinase, a mannanase, and/or an expansin protein. The invention further relates to recombinant *Bacillus cereus* family members that express the fusion proteins, exosporium fragments derived from the recombinant *Bacillus cereus* family members, and formulations containing the recombinant *Bacillus cereus* family members or exosporium fragments. Plant seeds treated with the recombinant *Bacillus cereus* family members, exosporium fragments, or formulations are also provided. Animal feed additives and animal feed compositions comprising the recombinant *Bacillus cereus* family members or exosporium fragments derived from the recombinant *Bacillus cereus* family members are also provided. The invention further relates to methods for stimulating plant growth and/or promoting plant health using the recombinant *Bacillus cereus* family members, exosporium fragments, or formulations. Method for delivering enzymes to an animal using the recombinant *Bacillus cereus* family members or exosporium fragments derived from the recombinant *Bacillus cereus* family members are also provided.

BACKGROUND OF THE INVENTION

Within the zone surrounding a plant's roots is a region called the rhizosphere. In the rhizosphere, bacteria, fungi, and other organisms compete for nutrients and for binding to the root structures of the plant. Both detrimental and beneficial bacteria and fungi can occupy the rhizosphere. The bacteria, fungi, and the root system of the plant can all be influenced by the actions of peptides, enzymes, and other proteins in the rhizosphere. Augmentation of soil or treatment of plants with certain of these peptides, enzymes, or other proteins would have beneficial effects on the overall populations of beneficial soil bacteria and fungi, create a healthier overall soil environment for plant growth, improve plant growth, and provide for the protection of plants against certain bacterial and fungal pathogens. However, previous attempts to introduce peptides, enzymes, and other proteins into soil to induce such beneficial effects on plants have been hampered by the low survival of enzymes, proteins, and peptides in soil. Additionally, the prevalence of proteases naturally present in the soil can lead to degradation of the proteins in the soil. The environment around the roots of a plant (the rhizosphere) is a unique mixture of bacteria, fungi, nutrients, and roots that has different qualities than that of native soil. The symbiotic relationship between these organisms is unique, and could be altered for the better with inclusion of exogenous proteins. The high concentration of fungi and bacteria in the rhizosphere causes even greater degradation of proteins due to abnormally high levels of proteases and other elements detrimental to proteins in the soil. In addition, enzymes and other proteins introduced into soil can dissipate away from plant roots quickly.

Thus, there exists a need in the art for a method for effectively delivering peptides, enzymes, and other proteins to plants (e.g., to plant root systems) and for extending the period of time during which such molecules remain active. Furthermore, there exists a need in the art for a method of selectively targeting such peptides, enzymes, and proteins to the rhizosphere and to plant leaves and plant roots in particular.

BRIEF SUMMARY OF THE INVENTION

A fusion protein is provided. The fusion protein comprises a targeting sequence, exosporium protein, or exosporium protein fragment that targets the fusion protein to the exosporium of a recombinant *Bacillus cereus* family member. The fusion protein also comprises an enzyme having 1-aminocyclopropane-1-carboxylate deaminase (ACC deaminase) activity. The enzyme having ACC deaminase activity comprises:

an amino acid sequence comprising at least one amino acid substitution relative to the sequence of a wild-type D-cysteine desulfhydrase or ACC deaminase enzyme from a *Bacillus* genus bacterium, wherein the amino acid substitution results in increased ACC deaminase activity as compared to the ACC deaminase activity of the wild-type D-cysteine desulfhydrase or ACC deaminase enzyme under the same conditions;

a *Bacillus* enzyme;

an amino acid sequence having at least 70%, at least 75%, at least 80%, at least 85%, at least 90%, at least 95%, at least 98%, or at least 99% identity to any one of SEQ ID NOs. 242-245;

or a combination of any thereof.

Another fusion protein is provided. The fusion protein comprises a targeting sequence, exosporium protein, or exosporium protein fragment that targets the fusion protein to the exosporium of a recombinant *Bacillus cereus* family member. The fusion protein also comprises a phospholipase. The phospholipase:

comprises a phospholipase B;

comprises a phospholipase C, the phospholipase C comprising a phospholipase C beta 1, a phospholipase C beta 2, a phospholipase C beta 3, a phospholipase C beta 4, a phospholipase C delta 1, a phospholipase C delta 3, a phospholipase C delta 4, a phospholipase C epsilon 1, a phospholipase C gamma 1, a phospholipase C gamma 2, a phospholipase C eta 1, a phospholipase C eta 2, a phospholipase C zeta 1, or a combination of any thereof;

comprises a phospholipase D, the phospholipase D comprising a phospholipase D1, a phospholipase D2, a phospholipase D member 3, a phospholipase D member 4, a phospholipase D member 5, a phospholipase D member 6, or a combination of any thereof;

comprises a phospholipase A2, the phospholipase A2 comprising a Group IIA phospholipase A2, a Group IIC phospholipase A2, a Group IID phospholipase A2, a Group IIE phospholipase A2, a Group IIF phospholipase A2, a Group III phospholipase A2, a Group IVA phospholipase A2, a Group IVB phospholipase A2, a Group IVC phospholipase A2, a Group IVD phospholipase A2, a Group IVE phospholipase A2, a Group VIF phospholipase A2, a Group V phospholipase A2, a Group VI phospholipase A2, a Group VII phospholipase A2, a Group X phospholipase A2, a Group XIIA phospholipase A2, a Group XIIB phospholipase A2, a Group XV phospholipase A2, a Group XVI phospholipase A2, or a combination of any thereof;

comprises a 1-alkyl-2-acetylglycerophosphocholine esterase;

comprises a phosphatidylinositol deacylase;

comprises a phosphatidylinoslitol-specific phospholipase C;

comprises a sphingomyelin phosphodiesterase;

comprises a sphingomyelin phosphodiesterase D;

comprises an alkylglycerophosphoethanolamine phosphodiesterase;

comprises a variant-surface-glycoprotein phospholipase C;

comprises a glycosylphosphatidylinositol phospholipase D;

comprises an N-acetylphosphatidylethanolamine-hydrolysing phospholipase D;

comprises a phosphatidylinositol diacylglycerol-lyase;

comprises a glycosylphosphatidylinositol diacylglycerol-lyase;

comprises a patatin-like phospholipase domain containing protein 2 (PNPLA2);

comprises a patatin-like phospholipase domain containing protein 3 (PNPLA3);

comprises a *Streptomyces* phospholipase;

comprises a *Clostridium* phospholipase;

comprises an *Acidovorax* phospholipase;

comprising *Listeria* phospholipase;

comprises a *Bacillus cereus* phospholipase;

comprises a *Bacillus licheniformis* phospholipase;

comprises an amino acid sequence having at least 70%, at least 75%, at least 80%, at least 85%, at least 90%, at least 95%, at least 98%, at least 99%, or 100% identity to any one of SEQ ID NOs. 252-260 and 373-375;

consists essentially of an amino acid sequence having at least 70%, at least 75%, at least 80%, at least 85%, at least 90%, at least 95%, at least 98%, at least 99%, or 100% identity to SEQ ID NO: 250 or 251;

or a combination of any thereof.

Yet another fusion protein is provided. The fusion protein comprises a targeting sequence, exosporium protein, or exosporium protein fragment that targets the fusion protein to the exosporium of a recombinant *Bacillus cereus* family member. The fusion protein further comprises a lipase. The lipase comprises:

a carboxyl ester lipase;
a diacylglycerol lipase alpha;
a diacylglycerol lipase beta;
a lipase A;
a hepatic lipase;
a hormone-sensitive lipase;
a gastric lipase;
an endothelial lipase;
a member H lipase;
a lipase family member I;
a lipase family member J;
a lipase family member K;
a lipase family member M;
a lipase family member N;
a lipoprotein lipase;
a monoglyceride lipase;
a pancreatic lipase-related protein 2;
a pancreatic lipase-related protein 3;
an acylglycerol lipase;
a galactolipase;
a lipoprotein lipase;
a *Burkholderia cepacia* lipase;
a *Burkholderia stearothermophilus* lipase;
a *Pseudomonas* lipase;
an amino acid sequence having at least 70%, at least 75%, at least 80%, at least 85%, at least 90%, at least 95%, at least 98%, at least 99%, or 100% identity to any one of SEQ ID NOs. 262-266;
or a combination of any thereof.

Another fusion protein is provided. The fusion protein comprises a targeting sequence, exosporium protein, or exosporium protein fragment that targets the fusion protein to the exosporium of a recombinant *Bacillus cereus* family member. The fusion protein also comprises a xylanase. The xylanase comprises:

a beta-xylanase;
a *Caldicellulosiruptor* xylanase;
a *Bacillus* xylanase;
a *Neocallimastix* xylanase;
a *Thermomyces* xylanase;
an amino acid sequence having at least 70%, at least 75%, at least 80%, at least 85%, at least 90%, at least 95%, at least 98%, at least 99%, or 100% identity to any one of SEQ ID NOs. 267-273;
or a combination of any thereof.

A further fusion protein is provided. The fusion protein comprises a targeting sequence, exosporium protein, or exosporium protein fragment that targets the fusion protein to the exosporium of a recombinant *Bacillus cereus* family member. The fusion protein also comprises a xylosidase. The xylosidase comprises:

a *Caldicellulosiruptor saccharolyticus* xylosidase;
a *Bacillus pumilus* xylosidase;
a *Bacillus subtilis* xylosidase;
an amino acid sequence having at least 70%, at least 75%, at least 80%, at least 85%, at least 90%, at least 95%, at least 98%, at least 99%, or 100% identity to any one of SEQ ID NOs. 274-276;
or a combination thereof.

Another fusion protein is provided. The fusion protein comprises a targeting sequence, exosporium protein, or exosporium protein fragment that targets the fusion protein to the exosporium of a recombinant *Bacillus cereus* family member. The fusion protein further comprises a lactonase. The lactonase comprises:

a *Bacillus* lactonase;
an *Agrobacterium* lactonase;
a *Rhodococcus* lactonase;
a *Streptomyces* lactonase;
an *Arthrobacter* lactonase;
a *Sphingomonas* lactonase;

a *Pseudomonas* lactonase;
a *Klebsiella* lactonase;
an amino acid sequence having at least 70%, at least 75%, at least 80%, at least 85%, at least 90%, at least 95%, at least 98%, at least 99%, or 100% identity to SEQ ID NO: 277 or 278;
or a combination of any thereof.

Yet another fusion protein is provided. The fusion protein comprises a targeting sequence, exosporium protein, or exosporium protein fragment that targets the fusion protein to the exosporium of a recombinant *Bacillus cereus* family member. The fusion protein also comprises a chitosanase. The chitosanase:
  comprises an exo-1,4-beta-D-glucosaminidase;
  comprises an endo-1,4-beta-d-glucosaminidase;
  comprises a *Streptomyces* chitosanase;
  comprises an amino acid sequence having at least 70%, at least 75%, at least 80%, at least 85%, at least 90%, at least 95%, at least 98%, at least 99%, or 100% identity to SEQ ID NO: 280;
  consists essentially of an amino acid sequence having at least 70%, at least 75%, at least 80%, at least 85%, at least 90%, at least 95%, at least 98%, at least 99%, or 100% identity to SEQ ID NO: 279;
  or a combination of any thereof.

A further fusion protein is provided. The fusion protein comprises a targeting sequence, exosporium protein, or exosporium protein fragment that targets the fusion protein to the exosporium of a recombinant *Bacillus cereus* family member. The fusion protein also comprises a protease. The protease comprises:
  an asparagine protease;
  a *Bacillus* protease;
  an *Aspergillus* protease;
  an amino acid sequence having at least 70%, at least 75%, at least 80%, at least 85%, at least 90%, at least 95%, at least 98%, at least 99%, or 100% identity to any one of SEQ ID NOs. 303-306;
  or a combination of any thereof.

Another fusion protein is provided. The fusion protein comprises a targeting sequence, exosporium protein, or exosporium protein fragment that targets the fusion protein to the exosporium of a recombinant *Bacillus cereus* family member. The fusion protein further comprises a glucanase. The glucanase:
  comprises an alpha-1,6-glucanase;
  comprises a beta 1,3/1,4 glucanase;
  comprises a xyloglucan:xyloglucosyl transferase;
  comprises a cycloheptaglucanase;
  comprises an oligoxyloglucan beta-glycosidase;
  comprises a cyclohexaglucanase;
  comprises a xyloglucanase;
  comprises a cellulose 1,4-beta-cellobiosidase;
  comprises a glucan endo-1,3-beta-D-glucosidase;
  comprises a cyclomaltodextrinase;
  comprises a glucan 1,3-beta-glucosidase;
  comprises a glucan endo-1,3-alpha-glucosidase;
  comprises an endo-1,3(4)-beta-glucanase;
  comprises a lichenase;
  comprises a laminarinase;
  comprises a glucan 1,4-beta-glucosidase;
  comprises a glucan endo-1,6-beta-glucosidase;
  comprises a glucan 1,3-alpha-glucosidase;
  comprises an amylopectinase;
  comprises an amyloglucanase;
  comprises an amyloglucosidase;
  comprises an *Acidothermus* glucanase;
  comprises an *Aspergillus* glucanase;
  comprises a *Paenibacillus* glucanase;
  comprises a *Helix* glucanase;
  comprises a *Bacillus circulans* glucanase;
  comprises a *Bacillus lichenformis* glucanase;
  comprises a *Clostridium* glucanase;
  comprises a *Trichoderma reesei* beta-1,4-endoglucanase;
  comprises a *Bacillus subtilis* amylase;
  comprises an amino acid sequence having at least 70%, at least 75%, at least 80%, at least 85%, at least 90%, at least 95%, at least 98%, at least 99%, or 100% identity to any one of SEQ ID NOs. 281-292 and 295-302;
  consists essentially of an amino acid sequence having at least 70%, at least 75%, at least 80%, at least 85%, at least 90%, at least 95%, at least 98%, at least 99%, or 100% identity to SEQ ID NO: 293 or 294;
  or a combination of any thereof.

Yet another fusion protein is provided. The fusion protein comprises a targeting sequence, exosporium protein, or exosporium protein fragment that targets the fusion protein to the exosporium of a recombinant *Bacillus cereus* family member. The fusion protein also comprises an expansin protein. The expansin protein comprises an amino acid sequence having at least 70%, at least 75%, at least 80%, at least 85%, at least 90%, at least 95%, at least 98%, at least 99%, or 100% identity to SEQ ID NO: 316.

A further fusion protein is provided. The fusion protein comprises a targeting sequence, exosporium protein, or exosporium protein fragment that targets the fusion protein to the exosporium of a recombinant *Bacillus cereus* family member. The fusion protein also comprises a phytase. The phytase comprises:
  a *Triticum* phytase;
  a *Bacillus* phytase;
  an amino acid sequence having at least 70%, at least 75%, at least 80%, at least 85%, at least 90%, at least 95%, at least 98%, at least 99%, or 100% identity to any one of SEQ ID NOs. 313-315 and 380;
  or a combination thereof.

Another fusion protein is provided. The fusion protein comprises a targeting sequence, exosporium protein, or exosporium protein fragment that targets the fusion protein to the exosporium of a recombinant *Bacillus cereus* family member. The fusion protein also comprises an acid phosphatase. The acid phosphatase comprises:
  a *Triticum* acid phosphatase;
  a *Bacillus* acid phosphatase;
  an amino acid sequence having at least 70%, at least 75%, at least 80%, at least 85%, at least 90%, at least 95%, at least 98%, at least 99%, or 100% identity to any one of SEQ ID NOs: 311, 312 and 378;
  or a combination thereof.

Yet another fusion protein is provided. The fusion protein comprises a targeting sequence, exosporium protein, or exosporium protein fragment that targets the fusion protein to the exosporium of a recombinant *Bacillus cereus* family member. The fusion protein further comprises a pectinase. The pectinase comprises a pectolyase.

A further fusion protein is provided. The fusion protein comprises a targeting sequence, exosporium protein, or exosporium protein fragment that targets the fusion protein to the exosporium of a recombinant *Bacillus cereus* family member. The fusion protein also comprises a mannanase.

A recombinant *Bacillus cereus* family member is provided. The recombinant *Bacillus cereus* family member expresses a fusion protein. The fusion protein can be any of the fusion proteins described herein.

Exosporium fragments are provided. The exosporium fragments are derived from a recombinant *Bacillus cereus* family member. The recombinant *Bacillus cereus* family member can be any of the recombinant *Bacillus cereus* family members described herein. The exosporium fragments can comprise any of the fusion proteins described herein.

A formulation is provided. The formulation comprises any of the recombinant *Bacillus cereus* family members described herein. The formulation further comprises an agriculturally acceptable carrier.

Another formulation is provided. The formulation comprises exosporium fragments derived from any of the recombinant *Bacillus cereus* family members described herein. The formulation further comprises an agriculturally acceptable carrier.

Yet another formulation is provided. The formulation comprises a recombinant *Bacillus cereus* family member that expresses a fusion protein. Alternatively, or in addition, the formulation comprises exosporium fragments derived from a *Bacillus cereus* family member that expresses a fusion protein. The fusion protein comprises a targeting sequence, exosporium protein, or exosporium protein fragment that targets the fusion protein to the exosporium of a recombinant *Bacillus cereus* family member. The fusion protein also comprises an acid phosphatase. The formulation further comprises a second enzyme.

Yet another formulation is provided. The formulation comprises a recombinant *Bacillus cereus* family member that expresses a fusion protein. Alternatively, or in addition, the formulation comprises exosporium fragments derived from a *Bacillus cereus* family member that expresses a fusion protein. The fusion protein comprises a targeting sequence, exosporium protein, or exosporium protein fragment that targets the fusion protein to the exosporium of a recombinant *Bacillus cereus* family member. The fusion protein also comprises a phospholipase C. The formulation further comprises a second enzyme.

A treated plant seed is provided. The plant seed can be treated with any of the recombinant *Bacillus cereus* family members described herein. The recombinant *Bacillus cereus* family member can express any of the fusion proteins described herein.

Another treated plant seed is provided. The plant seed can be treated with any of the exosporium fragments described herein. The exosporium fragments can be derived from any of the *Bacillus cereus* family members described herein. The exosporium fragments can comprise any of the fusion proteins described herein.

Yet another treated plant seed is provided. The plant seed can be treated with any of the formulations described herein.

An animal feed additive is provided. The animal feed additive can comprise any of the recombinant *Bacillus cereus* family members that expresses any of the fusion proteins described herein. Alternatively, or in addition, the animal feed additive can comprise exosporium fragments derived from any of the *Bacillus cereus* family members that expresses any of the fusion protein described herein.

An animal feed composition is also provided. The animal feed composition comprises animal feed and any of the recombinant *Bacillus cereus* family members that expresses a fusion protein described herein. Alternatively, or in addition, the animal feed composition can comprise animal feed and exosporium fragments derived from any of the recombinant *Bacillus cereus* family members described herein.

A method for stimulating plant growth and/or promoting plant health is provided. The method comprises applying a recombinant *Bacillus cereus* family member to a plant growth medium, a plant, a plant seed, or an area surrounding a plant or a plant seed. The recombinant *Bacillus cereus* family member can comprise any of the recombinant *Bacillus cereus* family members described herein. The recombinant *Bacillus cereus* family member can express any of the fusion proteins described herein.

Another method for stimulating plant growth and/or promoting plant health is provided. The method comprises applying exosporium fragments to a plant growth medium, a plant, a plant seed, or an area surrounding a plant or a plant seed. The exosporium fragments can comprise exosporium fragments derived from any of the recombinant *Bacillus cereus* family members described herein. The exosporium fragments can comprise any of the fusion proteins described herein.

Yet another method for stimulating plant growth and/or promoting plant health is provided. The method comprises applying a formulation to a plant growth medium, a plant, a plant seed, or an area surrounding a plant or a plant seed. The formulation can comprise any of the formulations described herein.

Another method for stimulating plant growth and/or promoting plant health is provided. The method comprises applying a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a xylosidase, a histidine protease, an acid phosphatase, or a combination of any thereof.

Yet another method for stimulating plant growth and/or promoting plant health is provided. The method comprises applying exosporium fragments derived from spores of a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a xylosidase, a histidine protease, an acid phosphatase, or a combination of any thereof.

A further method for stimulating plant growth and/or promoting plant health is provided. The method comprises applying a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises an acid phosphatase. The method further comprises applying a second enzyme to the plant growth medium, the plant, the plant seed, or the area surrounding the plant or the plant seed.

Another method for stimulating plant growth and/or promoting plant health is provided. The method comprises applying exosporium fragments derived from spores of a recombinant *Bacillus cereus* expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises an acid phosphatase. The method further comprises applying a second enzyme to the plant growth medium, the plant, the plant seed, or the area surrounding the plant or the plant seed.

Another method for stimulating plant growth and/or promoting plant health is provided. The method comprises applying a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a phospholipase C. The method further comprises applying a second enzyme to the plant growth medium, the plant, the plant seed, or the area surrounding the plant or the plant seed.

Another method for stimulating plant growth and/or promoting plant health is provided. The method comprises applying exosporium fragments derived from spores of a recombinant *Bacillus cereus* expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a phospholipase C. The method further comprises applying a second enzyme to the plant growth medium, the plant, the plant seed, or the area surrounding the plant or the plant seed.

A method for delivering an enzyme to an animal is provided. The method comprises feeding to the animal any of the recombinant *Bacillus cereus* family members that express a fusion protein described herein. Alternatively, or in addition, the method comprises feeding to the animal exosporium fragments derived from spores of any of the recombinant *Bacillus cereus* family members that express a fusion protein described herein.

Other objects and features will be in part apparent and in part pointed out hereinafter.

BRIEF DESCRIPTION OF THE DRAWINGS

FIGS. 1A and 1B show alignments of the amino acid sequence of an amino-terminal portion of *Bacillus anthracis* Sterne strain BclA and with the corresponding region from various exosporium proteins from *Bacillus cereus* family members.

FIG. 2 shows illustrative fluorescent microscopy results for the expression of fusion proteins containing various exosporium proteins linked to an mCherry reporter on the exosporium of a recombinant *Bacillus cereus* family member.

FIG. 3 is a transmission electron micrograph showing exosporium fragments and a *Bacillus cereus* family member spore from which the exosporium has been lost, generated using a recombinant *Bacillus cereus* family member having a knock-out mutation of its CotE gene.

FIG. 4 is a photograph of an SDS-PAGE gel showing a protein marker standard (lane 1) and proteins from exosporium fragments generated using a recombinant *Bacillus cereus* family member having a knock-out mutation of its CotE gene (lane 2).

FIG. 5 provides data illustrating enzyme activity of an acid phosphatase in exosporium fragments derived from a *Bacillus cereus* family member having a knock-out mutation of its CotE gene.

FIG. 6 provides a transmission electron micrographs showing: (A) intact spores of *Bacillus thuringiensis* BT013A surrounded by attached exosporium; (B) spores of an ExsY knockout strain of *Bacillus thuringiensis* BT013A, with detached exosporium; and (C) spores of a CotE knockout strain of *Bacillus thuringiensis* BT013A, with detached exosporium.

FIG. 7 provides a fluorescence microscopy image showing detection of endophytic bacteria isolated from inside of corn plants treated with *Bacillus thuringiensis* EE-B00184 expressing a fusion protein comprising amino acids 20-35 of SEQ ID NO: 1 and eGFP. Arrows denote single spores.

FIG. 8 provides a photograph showing fluorescence of bacterial colonies containing recombinant *Bacillus cereus* family members expressing a fusion protein comprising amino acids 20-35 of SEQ ID NO: 1 and eGFP, isolated from inside of corn plants grown from seeds coated with the recombinant bacteria.

FIG. 9 depicts a standard curve plotting average absorbance observed following the generation of a colored product from the reaction of α-KB standards (x-axis) with dinitrohydrozine (DNH).

FIG. 10 provides illustrative ACC deaminase enzyme activity results for non-transformed spores, spores expressing a D-cysteine desulfydrase, and spores expressing a ACC deaminase.

FIG. 11 depicts a standard curve plotting average absorbance of various concentrations of p-nitrophenol (pNP).

FIGS. 12 and 13 provides illustrative phospholipase C (PLC) activity data for spores expressing various PLC enzyme constructs.

DEFINITIONS

When the articles "a," "an," "one," "the," and "said" are used herein, they mean "at least one" or "one or more" unless otherwise indicated.

The term "*Bacillus cereus* family member" as used herein refers to any *Bacillus* species that is capable of producing an exosporium. Thus, the *Bacillus cereus* family of bacteria includes the species *Bacillus anthracis, Bacillus cereus, Bacillus thuringiensis, Bacillus mycoides, Bacillus pseudomycoides, Bacillus samanii, Bacillus gaemokensis, Bacillus weihenstephensis*, and *Bacillus toyoiensis*. *Bacillus cereus* family members are also referred to in the art as "*Bacillus cereus* senso lato."

The terms "comprising," "including" and "having" are intended to be inclusive and mean that there may be additional elements other than the listed elements.

The term "free enzyme" as used herein refers to an enzyme preparation that is substantially free of intact cells. The term "free enzyme" includes, but is not limited to, crude cell extracts containing an enzyme, partially purified, substantially purified, or purified enzyme. Free enzymes can optionally be immobilized on a chemical matrix or support to allow for controlled release of the enzyme. The term "immobilizing" as used herein in reference to immobilizing an enzyme on a matrix or support refers to the binding of the enzyme to the matrix or support such that the enzyme is maintained on the matrix or support or released from the support over a controlled period of time, instead of dissipating into the environment in an uncontrolled manner. Illustrative matrices and supports include, but are not limited to, charcoal, biochar, nanocarbon, agarose, an alginate, cellulose, a cellulose derivative, silica, plastic, stainless steel, glass, polystyrene, a ceramic, dolomite, a clay, diatomaceous earth, talc, a polymer, a gum, a water-dispersable material, and combinations of any thereof.

The term "foliar" used herein with respect to the application of enzymes or recombinant microorganisms to plants means that the enzyme or recombinant microorganism is applied to one or more aerial portions of the plant, including stems, leaves, fruits, flowers, or other exposed aerial portions of the plant.

The term "fusion protein" as used herein refers to a protein having a polypeptide sequence that comprises sequences derived from two or more separate proteins. A fusion protein can be generated by joining together a nucleic acid molecule that encodes all or part of a first polypeptide with a nucleic acid molecule that encodes all or part of a second polypeptide to create a nucleic acid sequence which, when expressed, yields a single polypeptide having functional properties derived from each of the original proteins.

The term "germination rate" as used herein refers to the number of seeds that germinate during a particular time period. For example, a germination rate of 85% indicates that 85 out of 100 seeds germinate during a given time period.

The term "inactivate" or "inactivation" as used herein in reference to the inactivation of spores of a recombinant Bacillus cereus family member means that the spores are unable to germinate, or that the spores can germinate, but are damaged such that germination does not result in a living bacterium. The terms "partially inactivate" or "partial inactivation" mean that a percentage of the spores are inactivated, but that some spores retain the ability to germinate and return to a live, replicating state. The term "genetic inactivation" refers to inactivation of spores a recombinant Bacillus cereus family member by a mutation of the spore's DNA that results in complete or partial inactivation of the spore. The terms "physical inactivation" and "chemical inactivation" refer to inactivation of spores using any physical or chemical means, e.g., by heat treatment, gamma irradiation, x-ray irradiation, UV-A irradiation, UV-B irradiation, or treatment with a solvent such as glutaraldehyde, formaldehyde, hydrogen peroxide, acetic acid, bleach, chloroform, phenol, or any combination thereof.

The terms "native sequence," "native amino acid sequence," "wild-type sequence," and "wild-type amino acid sequence" are used interchangeably herein to refer to an amino acid sequence as it exists in a naturally occurring protein.

A "plant growth medium" includes any material that is capable of supporting the growth of a plant.

The terms "promoting plant growth" and "stimulating plant growth" are used interchangeably herein, and refer to the ability to enhance or increase at least one of the plant's height, weight, leaf size, root size, fruit size, or stem size, and/or the ability to increase protein yield from the plant and/or to increase crop yield.

The term "recombinant" as used in reference to the bacteria described herein encompasses bacteria having any genetic modification as compared to wild-type bacteria of the same type, including bacteria that have been modified to delete of a gene or a portion of a gene (e.g., bacteria that have a "knock-out" of a gene), as well as bacteria that have been modified to express an exogenous peptide or protein.

The term "rhizosphere" is used interchangeably with "root zone" to denote that segment of the soil that surrounds the roots of a plant and is influenced by them.

The term "synergistically effective amount" as used herein refers an amount of a first substance (e.g., a first enzyme) that when used in combination with a second substance (e.g., a second enzyme) produces a biological effect that is greater than the sum of the biological effects of each of the respective first and second substances when used alone.

The term "targeting sequence" as used herein refers to a polypeptide sequence that, when present as part of a longer polypeptide or a protein, results in the localization of the longer polypeptide or the protein to a specific subcellular location. The targeting sequences described herein result in localization of proteins to the exosporium of a Bacillus cereus family member.

DETAILED DESCRIPTION OF THE INVENTION

I. Fusion Proteins for Expression in Bacillus Cereus Family Members

The present invention relates to fusion proteins comprising a targeting sequence, exosporium protein, or exosporium protein fragment that targets the fusion protein to the exosporium of a recombinant Bacillus cereus family member. The fusion proteins further comprise an ACC deaminase, a phospholipase, a lipase, a xylanase, a xylosidase, a lactonase, a chitosanase, a protease, a glucanase, a phytase, an acid phosphatase, a pectinase, a mannanase, and/or an expansin protein. When expressed in Bacillus cereus family member bacteria, these fusion proteins are targeted to the exosporium layer of the spore and are physically oriented such that the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase is displayed on the outside of the spore.

This Bacillus exosporium display (BEMD) system can be used to deliver the ACC deaminases, the phospholipases, the lipases, the xylanases, the xylosidases, the lactonases, the chitosanases, the proteases, the glucanases, the phytases, the acid phosphatases, the pectinases, the mannanases, and/or the expansin proteins to plants (e.g., to plant foliage, fruits, flowers, stems, or roots) or to a plant growth medium such as soil. Enzymes and proteins delivered to the soil or another plant growth medium in this manner persist and exhibit activity in the soil for extended periods of time. Introduction of recombinant Bacillus cereus family member bacteria expressing the fusion proteins described herein into soil or the rhizosphere of a plant leads to a beneficial enhancement of plant growth in many different soil conditions. The use of the BEMD to create these enzymes allows them to continue to exert their beneficial results to the plant and the rhizosphere over the first months of a plants life.

In addition, as is described further hereinbelow, the BEMD system can be modified such that the exosporium of the recombinant Bacillus cereus family member can be removed from the spore, generating exosporium fragments containing the fusion proteins. The exosporium fragments can also be used to deliver the ACC deaminases, the phospholipases, the lipases, the xylanases, the xylosidases, the lactonases, the chitosanases, the proteases, the glucanases, the phytases, the acid phosphatases, the pectinases, the mannanases, and/or the expansin proteins to plants in a cell-free preparation.

A. Targeting Sequences, Exosporium Proteins, and Exosporium Protein Fragments for Targeting Enzymes Having ACC Deaminase Activity, Phospholipases, Lipases, Xylanases, Xylosidases, Lactonases, Chitosanases, Proteases, Glucanases, Phytases, Acid Phosphatases, Pectinases, Mannanases, and Expansin Proteins to the Exosporium of a *Bacillus cereus* Family Member For ease of reference, descriptions of the amino acid sequences for the targeting sequences, exosporium proteins, and exosporium protein fragments that can be used for targeting of enzymes or proteins (e.g., enzymes having ACC deaminase activity, phospholipases, lipases, xylanases, xylosidases, lactonases, chitosanases, proteases, glucanases, phytases, acid phosphatases, pectinases, mannanases, and/or expansin proteins) to the exosporium of a *Bacillus cereus* family members, are provided in Table 1 together with their SEQ ID NOs.

TABLE 1

Peptide and protein sequences used for targeting of proteins or peptides of interest to the exosporium of *Bacillus cereus* family members

| Protein, protein fragment, or targeting sequence | SEQ ID NO. |
|---|---|
| AA 1-41 of BclA (*B. anthracis* Sterne) | 1 |
| Full length BclA (*B. anthracis* Sterne) | 2 |
| AA 1-33 of BetA/BAS3290 (*B. anthracis* Sterne) | 3 |
| Full length BetA/BAS3290 (*B. anthracis* Sterne) | 4 |
| Met + AA 2-43 of BAS4623 (*B. anthracis* Sterne) | 5 |
| Full length BAS4623 (*B. anthracis* Sterne) | 6 |
| AA 1-34 of BclB (*B. anthracis* Sterne) | 7 |
| Full length BclB (*B. anthracis* Sterne) | 8 |
| AA 1-30 of BAS1882 (*B. anthracis* Sterne) | 9 |
| Full length BAS1882 (*B. anthracis* Sterne) | 10 |
| AA 1-39 of gene 2280 (*B. weihenstephensis* KBAB4) | 11 |
| Full length KBAB4 gene 2280 (*B. weihenstephensis* KBAB4) | 12 |
| AA 1-39 of gene 3572 (*B. weihenstephensis* KBAB4) | 13 |
| Full Length KBAB4 gene 3572 (*B. weihenstephensis* KBAB4) | 14 |
| AA 1-49 of Exosporium Leader Peptide (*B. cereus* VD200) | 15 |
| Full Length Exosporium Leader Peptide(*B. cereus* VD200) | 16 |
| AA 1-33 of Exosporium Leader Peptide (*B. cereus* VD166) | 17 |
| Full Length Exosporium Leader Peptide (*B. cereus* VD166) | 18 |
| AA 1-39 of hypothetical protein IKG_04663 (*B. cereus* VD200) | 19 |
| Hypothetical protein IKG_04663, partial (*B. cereus* VD200) | 20 |
| AA 1-39 of YVTN β-propeller protein (*B. weihenstephensis* KBAB4) | 21 |
| Full length YVTN β-propeller protein KBAB4 (*B. weihenstephensis* KBAB4) | 22 |
| AA 1-30 of hypothetical protein bcerkbab4_2363 (*B. weihenstephensis* KBAB4) | 23 |
| Full length hypothetical protein bcerkbab4_2363 KBAB4 (*B. weihenstephensis* KBAB4) | 24 |
| AA 1-30 of hypothetical protein bcerkbab4_2131 (*B. weihenstephensis* KBAB4) | 25 |
| Full length hypothetical protein bcerkbab4_2131 (*B. weihenstephensis* KBAB4) | 26 |
| AA 1-36 of triple helix repeat containing collagen (*B. weihenstephensis* KBAB4) | 27 |
| Full length triple helix repeat-containing collagen KBAB4 | 28 |
| AA 1-39 of hypothetical protein bmyco0001_21660 (*B. mycoides* 2048) | 29 |
| Full length hypothetical protein bmyco0001_21660 (*B. mycoides* 2048) | 30 |
| AA 1-30 of hypothetical protein bmyc0001_22540 (*B. mycoides* 2048) | 31 |
| Full length hypothetical protein bmyc0001_22540 (*B. mycoides* 2048) | 32 |
| AA 1-21 of hypothetical protein bmyc0001_21510 (*B. mycoides* 2048) | 33 |
| Full length hypothetical protein bmyc0001_21510 (*B. mycoides* 2048) | 34 |
| AA 1-22 of collagen triple helix repeat protein (*B. thuringiensis* 35646) | 35 |
| Full length collagen triple helix repeat protein (*B. thuringiensis* 35646) | 36 |
| AA 1-35 of hypothetical protein WP_69652 (*B. cereus*) | 43 |
| Full length hypothetical protein WP_69652 (*B. cereus*) | 44 |
| AA 1-41 of exosporium leader WP016117717 (*B. cereus*) | 45 |
| Full length exosporium leader WP016117717(*B. cereus*) | 46 |
| AA 1-49 of exosporium peptide WP002105192 (*B. cereus*) | 47 |
| Full length exosporium peptide WP002105192 (*B. cereus*) | 48 |

TABLE 1-continued

Peptide and protein sequences used for targeting of proteins or peptides of interest to the exosporium of *Bacillus cereus* family members

| Protein, protein fragment, or targeting sequence | SEQ ID NO. |
|---|---|
| AA 1-38 of hypothetical protein WP87353 (*B. cereus*) | 49 |
| Full length hypothetical protein WP87353 (*B. cereus*) | 50 |
| AA 1-39 of exosporium peptide 02112369 (*B. cereus*) | 51 |
| Full length exosporium peptide 02112369 (*B. cereus*) | 52 |
| AA 1-39 of exosporium protein WP016099770 (*B. cereus*) | 53 |
| Full length exosporium protein WP016099770 (SEQ ID NO: 54) | 54 |
| AA 1-36 of hypothetical protein YP006612525 (*B. thuringiensis*) | 55 |
| Full length hypothetical protein YP006612525 (*B. thuringiensis*) | 56 |
| AA 1-136 of hypothetical protein TIGR03720 (*B. mycoides*) | 57* |
| Full length hypothetical protein TIGR03720 (*B. mycoides*) | 58* |
| AA 1-36 of collagen triple helix repeat domain protein (*B. cereus* ATCC 10987) | 59 |
| Full length collagen triple helix repeat domain protein (*B. cereus* ATCC 10987) | 60 |
| AA 1-39 of collagen-like protein (*B. cereus* E33L) | 61 |
| Full length collagen-like protein (*B. cereus* E33L) | 62 |
| AA 1-41 of triple helix repeat-containing collagen (*B. weihenstephanensis* KBAB4) | 63 |
| Full length triple helix repeat-containing collagen (*B. weihenstephanensis* KBAB4) | 64 |
| AA 1-30 of hypothetical protein BALH_2230 (*B. thuringiensis* str. Al Hakam) | 65 |
| Full length hypothetical protein BALH_2230 (*B. thuringiensis* str. Al Hakam) | 66 |
| AA 1-33 of triple helix repeat-containing collagen (*B. cereus* ATCC 14579) | 67 |
| Full length triple helix repeat-containing collagen (*B. cereus* ATCC 14579) | 68 |
| AA 1-44 of collagen triple helix repeat (*B. cereus*) | 69 |
| Full length collagen triple helix repeat (*B. cereus*) | 70 |
| AA 1-38 of triple helix repeat-containing collagen (*B. cereus* ATCC 14579) | 71 |
| Full length triple helix repeat-containing collagen (*B. cereus* ATCC 14579) | 72 |
| AA 1-30 of hypothetical protein BCZK1835 (*B. cereus* E33L) | 73 |
| Full length hypothetical protein BCZK1835 (*B. cereus* E33L) | 74 |
| AA 1-48 of triple helix repeat-containing collagen (*B. weihenstephanensis* KBAB4) | 75 |
| Full length triple helix repeat-containing collagen (*B. weihenstephanensis* KBAB4) | 76 |
| AA 1-30 of triple helix repeat-containing collagen (*B. cereus* ATCC 14579) | 77 |
| Full length triple helix repeat-containing collagen (*B. cereus* ATCC 14579) | 78 |
| AA 1-39 of hypothetical protein BC4725 (*B. cereus* ATCC 14579) | 79 |
| Full length hypothetical protein BC4725 (*B. cereus* ATCC 14579) | 80 |
| AA 1-44 of hypothetical protein BCZK4476 (*B. cereus* E33L) | 81 |
| Full length hypothetical protein BCZK4476 (*B. cereus* E33L) | 82 |
| AA 1-40 of triple helix repeat-containing collagen (*B. anthracis* str. 'Ames Ancestor') | 83 |
| Full length triple helix repeat-containing collagen (*B. anthracis* str. 'Ames Ancestor') | 84 |
| AA 1-34 of BclA protein (*B. thuringiensis* serovar konkukian str. 97-27) | 85 |
| Full length BclA protein (*B. thuringiensis* serovar konkukian str. 97-27) | 86 |
| AA 1-34 of conserved hypothetical protein (*B. cereus* ATCC 10987) | 87 |
| Full length conserved hypothetical protein (*B. cereus* ATCC 10987) | 88 |
| AA 1-34 of triple helix repeat-containing collagen (*B. cereus* ATCC 14579) | 89 |
| Full length triple helix repeat-containing collagen (*B. cereus* ATCC 14579) | 90 |
| AA 1-99 of exosporium leader peptide partial sequence (*B. cereus*) | 91 |
| Exosporium leader peptide partial sequence (*B. cereus*) | 92 |
| AA 1-136 of hypothetical protein ER45_27600, partial sequence (*B. weihenstephanensis*) | 93 |

TABLE 1-continued

Peptide and protein sequences used for targeting of proteins or peptides of interest to the exosporium of *Bacillus cereus* family members

| Protein, protein fragment, or targeting sequence | SEQ ID NO. |
|---|---|
| Hypothetical protein ER45_27600, partial sequence (*B. weihenstephanensis*) | 94 |
| AA 1-196 of BclA (*B. anthracis* Sterne) | 95 |
| Met + AA 20-35 of BclA (*B. anthracis* Sterne) | 96 |
| Met + AA 12-27 of BetA/BAS3290 (*B. anthracis* Sterne) | 97 |
| Met + AA 18-33 of gene 2280 (*B. weihenstephensis* KBAB4) | 98 |
| Met + AA 18-33 of gene 3572 (*B. weihenstephensis* KBAB4) | 99 |
| Met + AA 12-27 of Exosporium Leader Peptide (*B. cereus* VD166) | 100 |
| Met + AA 18-33 of YVTN β-propeller protein (*B. weihenstephensis* KBAB4) | 101 |
| Met + AA 9-24 of hypothetical protein bcerkbab4_2363 (*B. weihenstephensis* KBAB4) | 102 |
| Met + AA 9-24 of hypothetical protein bcerkbab4_2131 (*B. weihenstephensis* KBAB4) | 103 |
| Met + AA 9-24 of hypothetical protein bmyc0001_22540 (*B. mycoides* 2048) | 104 |
| Met + AA 9-24 of BAS1882 (*B. anthracis* Sterne) | 105 |
| Met + AA 20-35 of exosporium leader WP016117717 (*B. cereus*) | 106 |
| Met + AA 9-24 of hypothetical protein BALH_2230 (*B. thuringiensis* str. Al Hakam) | 107 |
| Full length InhA (*B. mycoides*) | 108 |
| Full length BAS1141 (ExsY) (*B. anthracis* Sterne) | 109 |
| Full length BAS1144 (BxpB/ExsFA) (*B. anthracis* Sterne) | 110 |
| Full length BAS1145 (CotY)(*B. anthracis* Sterne) | 111 |
| Full length BAS1140(*B. anthracis* Sterne) | 112 |
| Full length ExsFB (*B. anthracis* H9401) | 113 |
| Full length InhA1 (*B. thuringiensis* HD74) | 114 |
| Full length ExsJ (*B. cereus* ATCC 10876) | 115 |
| Full length ExsH (*B. cereus*) | 116 |
| Full length YjcA (*B. anthracis* Ames) | 117 |
| Full length YjcB (*B. anthracis*) | 118 |
| Full length BclC (*B. anthracis* Sterne) | 119 |
| Full length acid phosphatase (*Bacillus thuringiensis* serovar konkukian str. 97-27) | 120 |
| Full length InhA2 (*B. thuringiensis* HD74) | 121 |
| Full length InhA3 (*B. mycoides*) | 122 |
| Met + AA 23-38 of BAS4623 (*B. anthracis* Sterne) | 371 |
| Met + AA 13-28 of BclB (*B. anthracis* Sterne) | 372 |
| Cot Y variant (*Bacillus anthracis*) | 381 |
| BclA (*Bacillus thuringiensis*) | 382 |
| Amino acids 1-166 of BclA (*Bacillus thuringiensis*) | 383 |
| BclA (*Bacillus anthracis*) | 384 |
| AA 1-196 of BclA (*Bacillus anthracis*) | 385 |

AA = amino acids
*B. mycoides* hypothetical protein TIGR03720 has 100% sequence identity with *B. mycoides* hypothetical protein WP003189234. Thus, SEQ ID NOs: 57 and 58 also represent amino acids 1-136 of *B. mycoides* hypothetical protein WP003189234 and full length *B. mycoides* hypothetical protein WP003189234, respectively.

Bacillus is a genus of rod-shaped bacteria. The *Bacillus cereus* family of bacteria includes any *Bacillus* species that is capable of producing an exosporium. Thus, the *Bacillus cereus* family of bacteria includes the species *Bacillus anthracis, Bacillus cereus, Bacillus thuringiensis, Bacillus mycoides, Bacillus pseudomycoides, Bacillus samanii, Bacillus gaemokensis, Bacillus weihenstephensis*, and *Bacillus toyoiensis*. Under stressful environmental conditions, *Bacillus cereus* family bacteria undergo sporulation and form oval endospores that can stay dormant for extended periods of time. The outermost layer of the endospores is known as the exosporium and comprises a basal layer surrounded by an external nap of hair-like projections. Filaments on the hair-like nap are predominantly formed by the collagen-like glycoprotein BclA, while the basal layer is comprised of a number of different proteins. Another collagen-related protein, BclB, is also present in the exosporium and exposed on endospores of *Bacillus cereus* family members. BclA, the major constituent of the surface nap, has been shown to be attached to the exosporium with its amino-terminus (N-terminus) positioned at the basal layer and its carboxy-terminus (C-terminus) extending outward from the spore.

It was previously discovered that certain sequences from the N-terminal regions of BclA and BclB could be used to target a peptide or protein to the exosporium of a *Bacillus cereus* family member endospore (see U.S. Patent Application Publication Nos. 2010/0233124 and 2011/0281316, and Thompson et al., *Targeting of the BclA and BclB proteins to the Bacillus anthracis spore surface*, Molecular Microbiology 70(2):421-34 (2008)). It was also found that the BetA/BAS3290 protein of *Bacillus anthracis* localized to the exosporium. Further targeting sequences, as well as exosporium proteins and fragments of exosporium proteins, that can be incorporated into a fusion protein and used to target a peptide or protein of interest to the exosporium of a recombinant *Bacillus cereus* family member are described in U.S. Patent Application Publication Nos. 2016/0031948 and 2016/0108096, which are incorporated by reference herein in their entirety.

In particular, amino acids 20-35 of BclA from *Bacillus anthracis* Sterne strain have been found to be sufficient for targeting to the exosporium. A sequence alignment of amino acids 1-41 of BclA (SEQ ID NO: 1) with the corresponding N-terminal regions of several other *Bacillus cereus* family exosporium proteins and *Bacillus cereus* family proteins having related sequences is shown in FIGS. 1A and 1B. As can be seen from FIGS. 1A and 1B, there is a region of high homology among all of the proteins in the region corresponding to amino acids 20-41 of BclA. However, in these sequences, the amino acids corresponding to amino acids 36-41 of BclA contain secondary structure and are not necessary for fusion protein localization to the exosporium. The conserved targeting sequence region of BclA (amino acids 20-35 of SEQ ID NO: 1) is shown in bold in FIGS. 1A and 1B. A more highly conserved region spanning amino acids 25-35 of BclA within the targeting sequence is underlined in the sequences in FIGS. 1A and 1B, and is the recognition sequence for ExsFA/BxpB/ExsFB and homologs, which direct and assemble the described proteins on the surface of the exosporium. The amino acid sequences of SEQ ID NOs: 3, 5, and 7 in FIG. 1A are amino acids 1-33 of *Bacillus anthracis* Sterne strain BetA/BAS3290, a methionine followed by amino acids 2-43 of *Bacillus anthracis* Sterne strain BAS4623, and amino acids 1-34 of *Bacillus anthracis* Sterne strain BclB, respectively. (For BAS4623, it was found that replacing the valine present at position 1 in the native protein with a methionine resulted in better expression.) As can be seen from FIG. 1A, each of these sequences contains a conserved region corresponding to amino acids 20-35 of BclA (SEQ ID NO: 1; shown in bold), and a more highly conserved region corresponding to amino acids 20-35 of BclA (underlined).

Additional proteins from *Bacillus cereus* family members also contain the conserved targeting region. In particular, in FIGS. 1A and 1B, SEQ ID NO: 9 is amino acids 1-30 of *Bacillus anthracis* Sterne strain BAS1882, SEQ ID NO: 11 is amino acids 1-39 of the *Bacillus weihenstephensis* KBAB4 2280 gene product, SEQ ID NO: 13 is amino acids 1-39 of the *Bacillus weihenstephensis* KBAB4 3572 gene product, SEQ ID NO: 15 is amino acids 1-49 of *Bacillus cereus* VD200 exosporium leader peptide, SEQ ID NO: 17 is amino acids 1-33 of *Bacillus cereus* VD166 exosporium leader peptide, SEQ ID NO: 19 is amino acids 1-39 of *Bacillus cereus* VD200 hypothetical protein IKG_04663, SEQ ID NO: 21 is amino acids 1-39 of *Bacillus weihenste-*

*phensis* KBAB4 YVTN β-propeller protein, SEQ ID NO: 23 is amino acids 1-30 of *Bacillus weihenstephensis* KBAB4 hypothetical protein bcerkbab4_2363, SEQ ID NO: 25 is amino acids 1-30 of *Bacillus weihenstephensis* KBAB4 hypothetical protein bcerkbab4_2131, SEQ ID NO: 27 is amino acids 1-36 of *Bacillus weihenstephensis* KBAB4 triple helix repeat containing collagen, SEQ ID NO: 29 is amino acids 1-39 of *Bacillus mycoides* 2048 hypothetical protein bmyco0001_21660, SEQ ID NO: 31 is amino acids 1-30 of *Bacillus mycoides* 2048 hypothetical protein bmyc0001_22540, SEQ ID NO: 33 is amino acids 1-21 of *Bacillus mycoides* 2048 hypothetical protein bmyc0001_21510, SEQ ID NO: 35 is amino acids 1-22 of *Bacillus thuringiensis* 35646 collagen triple helix repeat protein, SEQ ID NO: 43 is amino acids 1-35 of *Bacillus cereus* hypothetical protein WP_69652, SEQ ID NO: 45 is amino acids 1-41 of *Bacillus cereus* exosporium leader WP016117717, SEQ ID NO: 47 is amino acids 1-49 of *Bacillus cereus* exosporium peptide WP002105192, SEQ ID NO: 49 is amino acids 1-38 of *Bacillus cereus* hypothetical protein WP87353, SEQ ID NO: 51 is amino acids 1-39 of *Bacillus cereus* exosporium peptide 02112369, SEQ ID NO: 53 is amino acids 1-39 of *Bacillus cereus* exosporium protein WP016099770, SEQ ID NO: 55 is amino acids 1-36 of *Bacillus thuringiensis* hypothetical protein YP006612525, SEQ ID NO: 57 is amino acids 1-136 of *Bacillus mycoides* hypothetical protein TIGR03720, SEQ ID NO: 59 is amino acids 1-36 of *B. cereus* ATCC 10987 collagen triple helix repeat domain protein, SEQ ID NO: 61 is amino acids 1-39 of *B. cereus* E33L collagen-like protein, SEQ ID NO: 63 is amino acids 1-41 of *B. weihenstephanensis* KBAB4 triple helix repeat-containing collagen, SEQ ID NO: 65 is amino acids 1-30 of *B. thuringiensis* str. Al Hakam hypothetical protein BALH_2230, SEQ ID NO: 67 is amino acids 1-33 of *B. cereus* ATCC 14579 triple helix repeat-containing collagen, SEQ ID NO: 69 is amino acids 1-44 of *B. cereus* collagen triple helix repeat, SEQ ID NO: 71 is amino acids 1-38 of *B. cereus* ATCC 14579 triple helix repeat-containing collagen, SEQ ID NO: 73 is amino acids 1-30 of *B. cereus* E33L hypothetical protein BCZK1835, SEQ ID NO: 75 is amino acids 1-48 of *B. weihenstephanensis* KBAB4 triple helix repeat-containing collagen, SEQ ID NO: 77 is amino acids 1-30 of *B. cereus* ATCC 14579 triple helix repeat-containing collagen, SEQ ID NO: 79 is amino acids 1-39 of *B. cereus* ATCC 14579 hypothetical protein BC4725, SEQ ID NO: 81 is amino acids 1-44 of *B. cereus* E33L hypothetical protein BCZK4476, SEQ ID NO: 83 is amino acids 1-40 of *B. anthracis* str. 'Ames Ancestor' triple helix repeat-containing collagen, SEQ ID NO: 85 is amino acids 1-34 of *B. thuringiensis* serovar konkukian str. 97-27 BclA protein, SEQ ID NO: 87 is amino acids 1-34 of *B. cereus* ATCC 10987 conserved hypothetical protein, SEQ ID NO: 89 is amino acids 1-34 of *B. cereus* ATCC 14579 triple helix repeat-containing collagen, SEQ ID NO: 91 is amino acids 1-99 of *B. cereus* exosporium leader peptide partial sequence, and SEQ ID NO: 93 is amino acids 1-136 of *B. weihenstephanensis* hypothetical protein ER45_27600. As shown in FIGS. 1A and 1B, each of the N-terminal regions of these proteins contains a region that is conserved with amino acids 20-35 of BclA (SEQ ID NO: 1), and a more highly conserved region corresponding to amino acids 25-35 of BclA.

Amino acids 1-41 of BclA from *B. thuringiensis* (SEQ ID NO: 382) and amino acids 1-41 of BclA from *B. anthracis* (SEQ ID NO: 384) are identical to SEQ ID NO: 2 and are thus not depicted in FIG. 1.

Any portion of BclA which includes amino acids 20-35 can be used as to target a fusion protein to the exosporium. In addition, full-length exosporium proteins or exosporium protein fragments can be used for targeting the fusion proteins to the exosporium. Thus, full-length BclA or a fragment of BclA that includes amino acids 20-35 can be used for targeting to the exosporium. For example, full length BclA (SEQ ID NO: 2, 382, or _384) or a midsized fragment of BclA that lacks the carboxy-terminus such as SEQ ID NO: 95 or 385 (amino acids 1-196 of BclA) or 383 (amino acids 1-166 of BclA) can be used to target the fusion proteins to the exosporium. Midsized fragments such as the fragments of SEQ ID NO: 95, 383, and 385 have less secondary structure than full length BclA and have been found to be suitable for use as a targeting sequence. The targeting sequence can also comprise much shorter portions of BclA which include amino acids 20-35, such as SEQ ID NO: 1 (amino acids 1-41 of BclA), amino acids 1-35 of SEQ ID NO: 1, amino acids 20-35 of SEQ ID NO: 1, or SEQ ID NO: 96 (a methionine residue linked to amino acids 20-35 of BclA). Even shorter fragments of BclA which include only some of amino acids 20-35 also exhibit the ability to target fusion proteins to the exosporium. For example, the targeting sequence can comprise amino acids 22-31 of SEQ ID NO: 1, amino acids 22-33 of SEQ ID NO: 1, or amino acids 20-31 of SEQ ID NO: 1.

Alternatively, any portion of BetA/BAS3290, BAS4623, BclB, BAS1882, the KBAB4 2280 gene product, the KBAB4 3572 gene product, *B. cereus* VD200 exosporium leader peptide, *B. cereus* VD166 exosporium leader peptide, *B. cereus* VD200 hypothetical protein IKG_04663, *B. weihenstephensis* KBAB4 YVTN β-propeller protein, *B. weihenstephensis* KBAB4 hypothetical protein bcerkbab4_2363, *B. weihenstephensis* KBAB4 hypothetical protein bcerkbab4_2131, *B. weihenstephensis* KBAB4 triple helix repeat containing collagen, *B. mycoides* 2048 hypothetical protein bmyco0001_21660, *B. mycoides* 2048 hypothetical protein bmyc0001_22540, *B. mycoides* 2048 hypothetical protein bmyc0001_21510, *B. thuringiensis* 35646 collagen triple helix repeat protein, *B. cereus* hypothetical protein WP_69652, *B. cereus* exosporium leader WP016117717, *B. cereus* exosporium peptide WP002105192, *B. cereus* hypothetical protein WP87353, *B. cereus* exosporium peptide 02112369, *B. cereus* exosporium protein WP016099770, *B. thuringiensis* hypothetical protein YP006612525, *B. mycoides* hypothetical protein TIGR03720, *B. cereus* ATCC 10987 collagen triple helix repeat domain protein, *B. cereus* E33L collagen-like protein, *B. weihenstephanensis* KBAB4 triple helix repeat-containing collagen, *B. thuringiensis* str. Al Hakam hypothetical protein BALH_2230, *B. cereus* ATCC 14579 triple helix repeat-containing collagen, *B. cereus* collagen triple helix repeat, *B. cereus* ATCC 14579 triple helix repeat-containing collagen, *B. cereus* E33L hypothetical protein BCZK1835, *B. weihenstephanensis* KBAB4 triple helix repeat-containing collagen, *B. cereus* ATCC 14579 triple helix repeat-containing collagen, *B. cereus* ATCC 14579 hypothetical protein BC4725, *B. cereus* E33L hypothetical protein BCZK4476, *B. anthracis* str. 'Ames Ancestor' triple helix repeat-containing collagen, *B. thuringiensis* serovar konkukian str. 97-27 BclA protein, *B. cereus* ATCC 10987 conserved hypothetical protein, *B. cereus* ATCC 14579 triple helix repeat-containing collagen, *B. cereus* exosporium leader peptide partial sequence, or *B. weihenstephanensis* hypothetical protein ER45_27600 which includes the amino acids corresponding to amino acids 20-35 of BclA can serve as the targeting sequence.

As can be seen from FIG. 1A, amino acids 12-27 of BetA/BAS3290, amino acids 23-38 of BAS4623, amino acids 13-28 of BclB, amino acids 9-24 of BAS1882, amino acids 18-33 of KBAB4 2280 gene product, amino acids 18-33 of KBAB4 3572 gene product, amino acids 28-43 of *B. cereus* VD200 exosporium leader peptide, amino acids 12-27 of *B. cereus* VD166 exosporium leader peptide, amino acids 18-33 of *B. cereus* VD200 hypothetical protein IKG_04663, amino acids 18-33 *B. weihenstephensis* KBAB4 YVTN β-propeller protein, amino acids 9-24 of *B. weihenstephensis* KBAB4 hypothetical protein bcerkbab4_2363, amino acids 9-24 of *B. weihenstephensis* KBAB4 hypothetical protein bcerkbab4_2131, amino acids 15-30 of *B. weihenstephensis* KBAB4 triple helix repeat containing collagen, amino acids 18-33 of *B. mycoides* 2048 hypothetical protein bmyco0001_21660, amino acids 9-24 of *B. mycoides* 2048 hypothetical protein bmyc0001_22540, amino acids 1-15 of *B. mycoides* 2048 hypothetical protein bmyc0001_21510, amino acids 1-16 of *B. thuringiensis* 35646 collagen triple helix repeat protein, amino acids 14-29 of *B. cereus* hypothetical protein WP_69652, amino acids 20-35 of *B. cereus* exosporium leader WP016117717, amino acids 28-43 of *B. cereus* exosporium peptide WP002105192, amino acids 17-32 of *B. cereus* hypothetical protein WP87353, amino acids 18-33 of *B. cereus* exosporium peptide 02112369, amino acids 18-33 of *B. cereus* exosporium protein WP016099770, amino acids 15-30 of *B. thuringiensis* hypothetical protein YP006612525, and amino acids 115-130 of *B. mycoides* hypothetical protein TIGR03720 correspond to amino acids 20-35 of BclA. As can be seen from FIG. 1B, amino acids 15-30 of *B. cereus* ATCC 10987 collagen triple helix repeat domain protein, amino acids 18-33 of *B. cereus* E33L collagen-like protein, amino acids 20-35 of *B. weihenstephanensis* KBAB4 triple helix repeat-containing collagen, amino acids 9-24 of *B. thuringiensis* str. Al Hakam hypothetical protein BALH_2230, amino acids 12-27 of *B. cereus* ATCC 14579 triple helix repeat-containing collagen, amino acids 23-38 of *B. cereus* collagen triple helix repeat, amino acids 17-32 of *B. cereus* ATCC 14579 triple helix repeat-containing collagen, amino acids 9-24 of *B. cereus* E33L hypothetical protein BCZK1835, amino acids 27-42 of *B. weihenstephanensis* KBAB4 triple helix repeat-containing collagen, amino acids 9-24 of *B. cereus* ATCC 14579 triple helix repeat-containing collagen, amino acids 18-33 of *B. cereus* ATCC 14579 hypothetical protein BC4725, amino acids 23-38 of *B. cereus* E33L hypothetical protein BCZK4476, amino acids 19-34 *B. anthracis* str. 'Ames Ancestor' triple helix repeat-containing collagen, amino acids 13-28 of *B. thuringiensis* serovar konkukian str. 97-27 BclA protein, amino acids 13-28 of *B. cereus* ATCC 10987 conserved hypothetical protein, amino acids 13-28 of *B. cereus* ATCC 14579 triple helix repeat-containing collagen, amino acids 78-93 of *B. cereus* exosporium leader peptide partial sequence, and amino acids 115-130 of *B. weihenstephanensis* hypothetical protein ER45_27600 correspond to amino acids 20-35 of BclA. Thus, any portion of these proteins that includes the above-listed corresponding amino acids can serve as the targeting sequence.

Furthermore, any amino acid sequence comprising amino acids 20-35 of BclA, or any of the above-listed corresponding amino acids, can serve as the targeting sequence.

The targeting sequence can comprise amino acids 1-35 of SEQ ID NO: 1, amino acids 20-35 of SEQ ID NO: 1, SEQ ID NO: 1, SEQ ID NO: 96, amino acids 22-31 of SEQ ID NO: 1, amino acids 22-33 of SEQ ID NO: 1, or amino acids 20-31 of SEQ ID NO: 1. Alternatively, the targeting sequence can consist of amino acids 1-35 of SEQ ID NO: 1, amino acids 20-35 of SEQ ID NO: 1, SEQ ID NO: 1, or SEQ ID NO: 96. Alternatively, the targeting sequence can consist of amino acids 22-31 of SEQ ID NO: 1, amino acids 22-33 of SEQ ID NO: 1, or amino acids 20-31 of SEQ ID NO: 1. Alternatively, the exosporium protein can comprise full length BclA (SEQ ID NO: 2), or the exosporium protein fragment can comprise a midsized fragment of BclA that lacks the carboxy-terminus, such as SEQ ID NO: 95 (amino acids 1-196 of BclA). Alternatively, the exosporium protein fragment can consist of SEQ ID NO: 95.

The targeting sequence can comprise amino acids 2-35 of SEQ ID NO: 1; amino acids 5-35 of SEQ ID NO: 1; amino acids 8-35 of SEQ ID NO: 1; amino acids 10-35 of SEQ ID NO: 1; or amino acids 15-35 of SEQ ID NO: 1.

The targeting sequence can comprise amino acids 1-27 of SEQ ID NO: 3, amino acids 12-27 of SEQ ID NO: 3, or SEQ ID NO: 3, or the exosporium protein can comprise full length BetA/BAS3290 (SEQ ID NO: 4). It has also been found that a methionine residue linked to amino acids 12-27 of BetA/BAS3290 can be used as a targeting sequence. Thus, the targeting sequence can comprise SEQ ID NO: 97. Alternatively, the targeting sequence can comprise amino acids 14-23 of SEQ ID NO: 3, amino acids 14-25 of SEQ ID NO: 3, or amino acids 12-23 of SEQ ID NO: 3.

The targeting sequence can comprise amino acids 2-27 of SEQ ID NO: 3; amino acids 5-27 of SEQ ID NO: 3; amino acids 8-27 of SEQ ID NO: 3; or amino acids 10-27 of SEQ ID NO: 3.

The targeting sequence can comprise amino acids 1-38 of SEQ ID NO: 5, amino acids 23-38 of SEQ ID NO: 5, SEQ ID NO: 5, or SEQ ID NO: 371 (a methionine residue linked to amino acids 23-38 of BAS4623) or the exosporium protein can comprise full length BAS4623 (SEQ ID NO: 6).

The targeting sequence can comprise amino acids 2-38 of SEQ ID NO: 5; amino acids 5-38 of SEQ ID NO: 5; amino acids 8-38 of SEQ ID NO: 5; amino acids 10-38 of SEQ ID NO: 5; amino acids 15-38 of SEQ ID NO: 5; or amino acids 20-38 of SEQ ID NO: 5.

Alternatively, the targeting sequence can comprise amino acids 1-28 of SEQ ID NO: 7, amino acids 13-28 of SEQ ID NO: 7, SEQ ID NO: 7, or SEQ ID NO: 372 (a methionine residue linked to amino acids 13-28 of BclB) or the exosporium protein can comprise full length BclB (SEQ ID NO:8).

The targeting sequence can comprise amino acids 2-28 of SEQ ID NO: 7; amino acids 5-28 of SEQ ID NO: 7; amino acids 8-28 of SEQ ID NO: 7; or amino acids 10-28 of SEQ ID NO: 7.

The targeting sequence can comprise amino acids 1-24 of SEQ ID NO: 9, amino acids 9-24 of SEQ ID NO: 9, or SEQ ID NO: 9, or the exosporium protein can comprise full length BAS1882 (SEQ ID NO: 10). A methionine residue linked to amino acids 9-24 of BAS1882 can be used as a targeting sequence. Thus, the targeting sequence can comprise SEQ ID NO: 105.

The targeting sequence can comprise amino acids 2-24 of SEQ ID NO: 9; amino acids 5-24 of SEQ ID NO: 9; or amino acids 8-24 of SEQ ID NO: 9.

The targeting sequence can comprise amino acids 1-33 of SEQ ID NO:11, amino acids 18-33 of SEQ ID NO: 11, or SEQ ID NO: 11, or the exosporium protein can comprise the full length *B. weihenstephensis* KBAB4 2280 gene product (SEQ ID NO: 12). A methionine residue linked to amino acids 18-33 of the *B. weihenstephensis* KBAB4 2280 gene product can be used as a targeting sequence. Thus, the targeting sequence can comprise SEQ ID NO: 98.

The targeting sequence can comprise amino acids 2-33 of SEQ ID NO: 11; amino acids 5-33 of SEQ ID NO: 11; amino acids 8-33 of SEQ ID NO: 11; amino acids 10-33 of SEQ ID NO: 11; or amino acids 15-33 of SEQ ID NO: 11.

The targeting sequence can also comprise amino acids 1-33 of SEQ ID NO: 13, amino acids 18-33 of SEQ ID NO: 13, or SEQ ID NO:13, or the exosporium protein can comprise the full length *B. weihenstephensis* KBAB4 3572 gene product (SEQ ID NO:14). A methionine residue linked to amino acids 18-33 of the *B. weihenstephensis* KBAB4 3572 gene product can be used as a targeting sequence. Thus, the targeting sequence can comprise SEQ ID NO: 99.

The targeting sequence can comprise amino acids 2-33 of SEQ ID NO: 13; amino acids 5-33 of SEQ ID NO: 13; amino acids 8-33 of SEQ ID NO: 13; amino acids 10-33 of SEQ ID NO: 13; or amino acids 15-33 of SEQ ID NO: 13.

Alternatively, the targeting sequence can comprise amino acids 1-43 of SEQ ID NO: 15, amino acids 28-43 of SEQ ID NO: 15, or SEQ ID NO:15, or the exosporium protein can comprise full length *B. cereus* VD200 exosporium leader peptide (SEQ ID NO:16).

The targeting sequence can comprise amino acids 2-43 of SEQ ID NO: 15; amino acids 5-43 of SEQ ID NO: 15; amino acids 8-43 of SEQ ID NO: 15; amino acids 10-43 of SEQ ID NO: 15; amino acids 15-43 of SEQ ID NO: 15; amino acids 20-43 of SEQ ID NO: 15; or amino acids 25-43 of SEQ ID NO: 15.

The targeting sequence can also comprise amino acids 1-27 of SEQ ID NO: 17, amino acids 12-27 of SEQ ID NO: 17, or SEQ ID NO: 17, or the exosporium protein can comprise full-length *B. cereus* VD166 exosporium leader peptide (SEQ ID NO:18). A methionine residue linked to amino acids 12-27 of the *B. cereus* VD166 exosporium leader peptide can be used as a targeting sequence. Thus, the targeting sequence can comprise SEQ ID NO: 100.

The targeting sequence can comprise amino acids 2-27 of SEQ ID NO: 17; amino acids 5-27 of SEQ ID NO: 17; amino acids 8-27 of SEQ ID NO: 17; or amino acids 10-27 of SEQ ID NO: 17.

The targeting sequence can also comprise amino acids 1-33 of SEQ ID NO: 19, amino acids 18-33 of SEQ ID NO: 19, or SEQ ID NO:19, or the exosporium protein can comprise full length *B. cereus* VD200 hypothetical protein IKG_04663 (SEQ ID NO:20).

The targeting sequence can comprise amino acids 2-33 of SEQ ID NO: 19; amino acids 5-33 of SEQ ID NO: 19; amino acids 8-33 of SEQ ID NO: 19; amino acids 10-33 of SEQ ID NO: 19; or amino acids 15-33 of SEQ ID NO: 19.

Alternatively, the targeting sequence comprises amino acids 1-33 of SEQ ID NO: 21, amino acids 18-33 of SEQ ID NO: 21, or SEQ ID NO:21, or the exosporium protein can comprise full length *B. weihenstephensis* KBAB4 YVTN β-propeller protein (SEQ ID NO: 22). A methionine residue linked to amino acids 18-33 of the *B. weihenstephensis* KBAB4 YVTN β-propeller protein can be used as a targeting sequence. Thus, the targeting sequence can comprise SEQ ID NO: 101.

The targeting sequence can comprise amino acids 2-33 of SEQ ID NO: 21; amino acids 5-33 of SEQ ID NO: 21; amino acids 8-33 of SEQ ID NO: 21; amino acids 10-33 of SEQ ID NO: 21; or amino acids 15-33 of SEQ ID NO: 21.

The targeting sequence can also comprise amino acids 1-24 of SEQ ID NO: 23, amino acids 9-24 of SEQ ID NO: 23, or SEQ ID NO:23, or the exosporium protein can comprise full length *B. weihenstephensis* KBAB4 hypothetical protein bcerkbab4_2363 (SEQ ID NO:24). A methionine residue linked to amino acids 9-24 of *B. weihenstephensis* KBAB4 hypothetical protein bcerkbab4_2363 can be used as a targeting sequence. Thus, the targeting sequence can comprise SEQ ID NO: 102.

The targeting sequence can comprise amino acids 2-24 of SEQ ID NO:23; amino acids 5-24 of SEQ ID NO: 23; or amino acids 8-24 of SEQ ID NO: 23.

The targeting sequence comprise amino acids 1-24 of SEQ ID NO: 25, amino acids 9-24 of SEQ ID NO: 25, or SEQ ID NO: 25, or the exosporium protein can comprise full length *B. weihenstephensis* KBAB4 hypothetical protein bcerkbab4_2131 (SEQ ID NO:26). A methionine residue linked to amino acids 9-24 of *B. weihenstephensis* KBAB4 hypothetical protein bcerkbab4_2131 can be used as a targeting sequence. Thus, the targeting sequence can comprise SEQ ID NO: 103.

The targeting sequence can comprise amino acids 2-24 of SEQ ID NO: 25; amino acids 5-24 of SEQ ID NO: 25; or amino acids 8-24 of SEQ ID NO: 25.

Alternatively, the targeting sequence comprises amino acids 1-30 of SEQ ID NO: 27, amino acids 15-30 of SEQ ID NO: 27, or SEQ ID NO:27, or the exosporium protein can comprise full length *B. weihenstephensis* KBAB4 triple helix repeat containing collagen (SEQ ID NO:28).

The targeting sequence can comprise amino acids 2-30 of SEQ ID NO: 27; amino acids 5-30 of SEQ ID NO: 27; amino acids 8-30 of SEQ ID NO: 27; or amino acids 10-30 of SEQ ID NO: 27.

The targeting sequence can also comprise amino acids 1-33 of SEQ ID NO: 29, amino acids 18-33 of SEQ ID NO: 29, or SEQ ID NO:29, or the exosporium protein can comprise full length *B. mycoides* 2048 hypothetical protein bmyco0001_21660 (SEQ ID NO:30).

The targeting sequence can comprise amino acids 2-33 of SEQ ID NO: 29; amino acids 5-33 of SEQ ID NO: 29; amino acids 8-33 of SEQ ID NO: 29; amino acids 10-33 of SEQ ID NO: 29; or amino acids 15-33 of SEQ ID NO: 29.

The targeting sequence can also comprise amino acids 1-24 of SEQ ID NO: 31, amino acids 9-24 of SEQ ID NO: 31, or SEQ ID NO:31, or the exosporium protein can comprise full length *B. mycoides* 2048 hypothetical protein bmyc0001_22540 (SEQ ID NO:32). A methionine residue linked to amino acids 9-24 of *B. mycoides* 2048 hypothetical protein bmyc0001_22540 can be used as a targeting sequence. Thus, the targeting sequence can comprise SEQ ID NO: 104.

The targeting sequence can comprise amino acids 2-24 of SEQ ID NO: 31; amino acids 5-24 of SEQ ID NO: 31; or amino acids 8-24 of SEQ ID NO: 31.

Alternatively, the targeting sequence comprises amino acids 1-15 of SEQ ID NO: 33, SEQ ID NO:33, or the exosporium protein comprises full length *B. mycoides* 2048 hypothetical protein bmyc0001_21510 (SEQ ID NO:34).

The targeting sequence can also comprise amino acids 1-16 of SEQ ID NO: 35, SEQ ID NO:35, or the exosporium protein can comprise full length *B. thuringiensis* 35646 collagen triple helix repeat protein (SEQ ID NO:36).

The targeting sequence can comprise amino acids 1-29 of SEQ ID NO:43, amino acids 14-29 of SEQ ID NO: 43, or SEQ ID NO: 43, or the exosporium protein can comprise full length *B. cereus* hypothetical protein WP_69652 (SEQ ID NO: 44).

The targeting sequence can comprise amino acids 2-29 of SEQ ID NO: 43; amino acids 5-29 of SEQ ID NO: 43; amino acids 8-29 of SEQ ID NO: 43; or amino acids 10-29 of SEQ ID NO: 43.

Alternatively, the targeting sequence can comprise amino acids 1-35 of SEQ ID NO: 45, amino acids 20-35 of SEQ ID NO: 45, or SEQ ID NO: 45, or the exosporium protein can comprise full length *B. cereus* exosporium leader WP016117717 (SEQ ID NO: 46). A methionine residue linked to amino acids 20-35 of *B. cereus* exosporium leader WP016117717 can be used as a targeting sequence. Thus, the targeting sequence can comprise SEQ ID NO: 106.

The targeting sequence can comprise amino acids 2-35 of SEQ ID NO: 45; amino acids 5-35 of SEQ ID NO: 45; amino acids 8-35 of SEQ ID NO: 45; amino acids 10-35 of SEQ ID NO: 45; or amino acids 15-35 of SEQ ID NO: 45.

The targeting sequence can comprise amino acids 1-43 of SEQ ID NO: 47, amino acids 28-43 of SEQ ID NO: 47, or SEQ ID NO: 47, or the exosporium protein can comprise full length *B. cereus* exosporium peptide WP002105192 (SEQ ID NO: 48).

The targeting sequence can comprise amino acids 2-43 of SEQ ID NO: 47; amino acids 5-43 of SEQ ID NO: 47; amino acids 8-43 of SEQ ID NO: 47; amino acids 10-43 of SEQ ID NO: 47; amino acids 15-43 of SEQ ID NO: 47; amino acids 20-43 of SEQ ID NO: 47; or amino acids 25-43 of SEQ ID NO: 47.

The targeting sequence can comprise amino acids 1-32 of SEQ ID NO: 49, amino acids 17-32 of SEQ ID NO: 49, or SEQ ID NO: 49, or the exosporium protein can comprise full length *B. cereus* hypothetical protein WP87353 (SEQ ID NO: 50).

The targeting sequence can comprise amino acids 2-32 of SEQ ID NO: 49; amino acids 5-32 of SEQ ID NO: 49; amino acids 8-32 of SEQ ID NO: 49; amino acids 10-32 of SEQ ID NO: 49; or amino acids 15-32 of SEQ ID NO: 49.

Alternatively, the targeting sequence can comprise amino acids 1-33 of SEQ ID NO: 51, amino acids 18-33 of SEQ ID NO: 51, or SEQ ID NO: 51, or the exosporium protein can comprise full length *B. cereus* exosporium peptide 02112369 (SEQ ID NO: 52).

The targeting sequence can comprise amino acids 2-33 of SEQ ID NO: 51; amino acids 5-33 of SEQ ID NO: 51; amino acids 8-33 of SEQ ID NO: 51; amino acids 10-33 of SEQ ID NO: 51; or amino acids 15-33 of SEQ ID NO: 51.

The targeting sequence can comprise amino acids 1-33 of SEQ ID NO: 53, amino acids 18-33 of SEQ ID NO: 53, or SEQ ID NO: 53, or the exosporium protein can comprise full length *B. cereus* exosporium protein WP016099770 (SEQ ID NO: 54).

The targeting sequence can comprise amino acids 2-33 of SEQ ID NO: 53; amino acids 5-33 of SEQ ID NO: 53; amino acids 8-33 of SEQ ID NO: 53; amino acids 10-33 of SEQ ID NO: 53; or amino acids 15-33 of SEQ ID NO: 53.

Alternatively, the targeting sequence can comprise acids 1-30 of SEQ ID NO: 55, amino acids 15-30 of SEQ ID NO: 55, or SEQ ID NO: 55, or the exosporium protein can comprise full length *B. thuringiensis* hypothetical protein YP006612525 (SEQ ID NO: 56).

The targeting sequence can comprise amino acids 2-30 of SEQ ID NO: 55; amino acids 5-30 of SEQ ID NO: 55; amino acids 8-30 of SEQ ID NO: 55; or amino acids 10-30 of SEQ ID NO: 55.

The targeting sequence can comprise amino acids 1-130 of SEQ ID NO: 57, amino acids 115-130 of SEQ ID NO: 57, or SEQ ID NO: 57, or the exosporium protein can comprise full length *B. mycoides* hypothetical protein TIGR03720 (SEQ ID NO: 58).

The targeting sequence can comprise amino acids 2-130 of SEQ ID NO: 57; amino acids 5-130 of SEQ ID NO: 57; amino acids 10-130 of SEQ ID NO: 57; amino acids 20-130 of SEQ ID NO: 57; amino acids 30-130 of SEQ ID NO: 57; amino acids 40-130 of SEQ ID NO: 57; amino acids 50-130 of SEQ ID NO: 57; amino acids 60-130 of SEQ ID NO: 57; amino acids 70-130 of SEQ ID NO: 57; amino acids 80-130 of SEQ ID NO: 57; amino acids 90-130 of SEQ ID NO: 57; amino acids 100-130 of SEQ ID NO: 57; or amino acids 110-130 of SEQ ID NO: 57.

The targeting sequence can comprise amino acids 1-30 of SEQ ID NO: 59; or SEQ ID NO: 59; or the exosporium protein can comprise full length *B. cereus* ATCC 10987 collagen triple helix repeat domain protein (SEQ ID NO: 60).

The targeting sequence can comprise amino acids 2-30 of SEQ ID NO: 59; amino acids 4-30 of SEQ ID NO: 59; or amino acids 6-30 of SEQ ID NO: 59.

The targeting sequence can comprise amino acids 1-33 of SEQ ID NO: 61; amino acids 18-33 of SEQ ID NO: 61; or SEQ ID NO: 61; or the exosporium protein can comprise full length *B. cereus* E33L collagen-like protein (SEQ ID NO: 62).

The targeting sequence can comprise amino acids 2-33 of SEQ ID NO: 61; amino acids 5-33 of SEQ ID NO: 61; amino acids 10-33 of SEQ ID NO: 61; or amino acids 15-33 of SEQ ID NO: 61.

The targeting sequence can comprise amino acids 1-35 of SEQ ID NO: 63; or SEQ ID NO: 63; or the exosporium protein can comprise full length *B. weihenstephanensis* KBAB4 triple helix repeat-containing collagen (SEQ ID NO: 64).

The targeting sequence can comprise amino acids 2-35 of SEQ ID NO: 63; amino acids 5-35 of SEQ ID NO: 63; amino acids 8-35 of SEQ ID NO: 63; amino acids 10-35 of SEQ ID NO: 63; or amino acids 15-35 of SEQ ID NO: 63.

The targeting sequence can comprise amino acids 1-24 of SEQ ID NO: 65; acids 9-24 of SEQ ID NO: 65; SEQ ID NO: 65; or SEQ ID NO: 107; or the exosporium protein can comprise full length *B. thuringiensis* str. Al Hakam hypothetical protein BALH_2230 (SEQ ID NO: 66).

The targeting sequence can comprise amino acids 2-24 of SEQ ID NO: 65; or amino acids 5-24 of SEQ ID NO: 65.

The targeting sequence can comprise acids 1-27 of SEQ ID NO: 67; amino acids 12-27 of SEQ ID NO: 67; or SEQ ID NO: 67; or the exosporium protein can comprise full length *B. cereus* ATCC 14579 triple helix repeat-containing collagen (SEQ ID NO: 68).

The targeting sequence can comprise amino acids 2-27 of SEQ ID NO: 67; amino acids 5-27 of SEQ ID NO: 67; or amino acids 10-27 of SEQ ID NO: 67.

The targeting sequence can comprise amino acids 1-38 of SEQ ID NO: 69; amino acids 23-38 of SEQ ID NO: 69; or SEQ ID NO: 69; or the exosporium protein can comprise full length *B. cereus* collagen triple helix repeat (SEQ ID NO: 70).

The targeting sequence can comprise amino acids 2-38 of SEQ ID NO: 69; amino acids 5-38 of SEQ ID NO: 69; amino acids 10-38 of SEQ ID NO: 69; or amino acids 15-38 of SEQ ID NO: 69.

The exosporium protein can comprise full length *B. cereus* ATCC 14579 triple helix repeat-containing collagen (SEQ ID NO: 72).

The targeting sequence can comprise SEQ ID NO: 73, or the exosporium protein can comprise full length *B. cereus* E33L hypothetical protein BCZK1835 (SEQ ID NO: 74).

The targeting sequence can comprise amino acids 1-42 of SEQ ID NO: 75; amino acids 27-42 of SEQ ID NO: 75; or SEQ ID NO: 75; or the exosporium protein can comprise full length *B. weihenstephanensis* KBAB4 triple helix repeat-containing collagen (SEQ ID NO: 76).

The targeting sequence can comprise amino acids 2-42 of SEQ ID NO: 75; amino acids 5-42 of SEQ ID NO: 75; amino acids 10-42 of SEQ ID NO: 75; amino acids 15-42 of SEQ ID NO: 75; amino acids 20-42 of SEQ ID NO: 75; or amino acids 25-42 of SEQ ID NO: 75.

The targeting sequence can comprise amino acids 1-24 of SEQ ID NO: 77; amino acids 9-24 of SEQ ID NO: 77; or SEQ ID NO: 77; or the exosporium protein can comprise full length *B. cereus* ATCC 14579 triple helix repeat-containing collagen (SEQ ID NO: 78).

The targeting sequence can comprise amino acids 2-24 of SEQ ID NO: 77; or amino acids 5-24 of SEQ ID NO: 77;

The exosporium protein can comprise full length *B. cereus* ATCC 14579 hypothetical protein BC4725 (SEQ ID NO: 80).

The targeting sequence can comprise amino acids 1-38 of SEQ ID NO: 81; amino acids 23-38 of SEQ ID NO: 81; or SEQ ID NO: 81; or the exosporium protein can comprise full length *B. cereus* E33L hypothetical protein BCZK4476 (SEQ ID NO: 82).

The targeting sequence can comprise amino acids 2-38 of SEQ ID NO: 81; acids 5-38 of SEQ ID NO: 81; amino acids 10-38 of SEQ ID NO: 81; amino acids 15-38 of SEQ ID NO: 81; or amino acids 20-38 of SEQ ID NO: 81.

The targeting sequence can comprise amino acids 1-34 of SEQ ID NO: 83; or SEQ ID NO: 83; or the exosporium protein can comprise full length *B. anthracis* str. 'Ames Ancestor' triple helix repeat-containing collagen (SEQ ID NO: 84).

The exosporium protein can comprise full length *B. thuringiensis* serovar konkukian str. 97-27 BclA protein (SEQ ID NO: 86).

The targeting sequence can comprise amino acids 1-28 of SEQ ID NO: 87; amino acids 13-28 of SEQ ID NO: 87; or SEQ ID NO: 87; or the exosporium protein can comprise full length *B. cereus* ATCC 10987 conserved hypothetical protein (SEQ ID NO: 88).

The targeting sequence can comprise amino acids 2-28 of SEQ ID NO: 87; amino acids 5-28 of SEQ ID NO: 87; or amino acids 10-28 of SEQ ID NO: 87.

The targeting sequence can comprise amino acids 1-28 of SEQ ID NO: 89; or SEQ ID NO: 89; or the exosporium protein can comprise full length *B. cereus* ATCC 14579 triple helix repeat-containing collagen (SEQ ID NO: 90).

The targeting sequence can comprise amino acids 2-28 of SEQ ID NO: 89; amino acids 5-28 of SEQ ID NO: 89; or amino acids 10-28 of SEQ ID NO: 89

The targeting sequence can comprise amino acids 1-93 of SEQ ID NO: 91; or SEQ ID NO: 91; or the exosporium protein can comprise *B. cereus* exosporium leader peptide partial sequence (SEQ ID NO: 92).

The targeting sequence can comprise amino acids 2-93 of SEQ ID NO: 91; amino acids 10-93 of SEQ ID NO: 91; amino acids 20-93 of SEQ ID NO: 91; amino acids 30-93 of SEQ ID NO: 91; amino acids 40-93 of SEQ ID NO: 91; amino acids 50-93 of SEQ ID NO: 91; or amino acids 60-93 of SEQ ID NO: 91.

The targeting sequence can comprise amino acids 1-130 of SEQ ID NO: 93; or SEQ ID NO: 93; or the exosporium protein can comprise *B. weihenstephanensis*) hypothetical protein ER45_27600, partial sequence (SEQ ID NO: 94).

The targeting sequence can comprise amino acids 2-130 of SEQ ID NO: 93; amino acids 10-130 of SEQ ID NO: 93; amino acids 20-130 of SEQ ID NO: 93; or amino acids 30-130 of SEQ ID NO: 93.

The targeting sequence can comprise amino acids 1-35 of SEQ ID NO:382, amino acids 20-35 of SEQ ID NO: 382, SEQ ID NO: 382, or SEQ ID NO: 383.

The targeting sequence can comprise amino acids 1-35 of SEQ ID NO:384, amino acids 20-35 of SEQ ID NO: 384, SEQ ID NO: 384, or SEQ ID NO: 385.

Furthermore, as illustrated in the Examples provided hereinbelow, it has been found that sequences shorter than amino acids 20-35 of BclA can be used to target a fusion protein to the exosporium of a recombinant *Bacillus cereus* family member. In particular, amino acids 20-33 of BclA, amino acids 20-31 of BclA, amino acids 21-33 of BclA, or amino acids 23-31 of BclA can be used to target a fusion protein to the exosporium of a recombinant *Bacillus cereus* family member. Thus, the targeting sequence can consist of amino acids 20-33 of SEQ ID NO: 1, amino acids 20-31 of SEQ ID NO: 1, amino acids 21-33 of SEQ ID NO: 1, or amino acids 23-31 of SEQ ID NO: 1. The corresponding regions of any of the SEQ ID NOs. shown in FIGS. 1A and 1B can also be used to target a fusion protein to the exosporium of a recombinant *Bacillus cereus* family member. By "corresponding regions," it is meant that when the sequences are aligned with SEQ ID NO: 1, as shown in FIGS. 1A and 1B, the regions of the other amino acid sequences that align with the amino acids of SEQ ID NO: are the "corresponding regions" of those sequences. Thus, for example, amino acids 12-25 of SEQ ID NO: 3, amino acids 23-36 of SEQ ID NO: 5, amino acids 13-26 of SEQ ID NO: 7, etc. can be used to target a fusion protein to the exosporium of a recombinant *Bacillus cereus* family member, since these regions align with amino acids 20-33 of SEQ ID NO: 1 as shown in FIG. 1A.

Even shorter regions within amino acids 20-35 of BclA can also be used for targeting a fusion protein to the exosporium of a recombinant *Bacillus cereus* family member. In particular, any amino acid sequence that includes amino acids 25-30 of SEQ ID NO: 1 or the corresponding amino acids from any of the sequences shown in FIGS. 1A and 1B can be used. A skilled person will recognize that starting with amino acids 25-30 of SEQ ID NO: 1 or the corresponding region of any of the sequences shown in FIGS. 1A and 1B, additional amino acids can be added to the amino-terminus, the carboxy terminus, or both the amino- and carboxy termini to create a targeting sequence that will be effective for targeting a fusion protein to the exosporium of a recombinant *Bacillus cereus* family member.

In addition, it can readily be seen from the sequence alignment in FIGS. 1A and 1B that while amino acids 20-35 of BclA are conserved, and amino acids 25-35 are more conserved, some degree of variation can occur in this region without affecting the ability of the targeting sequence to target a protein to the exosporium. FIGS. 1A and 1B list the percent identity of each of the corresponding amino acids of each sequence to amino acids 20-35 of BclA ("20-35% Identity") and to amino acids 25-35 of BclA ("25-35% Identity"). Thus, for example, as compared to amino acids 20-35 of BclA, the corresponding amino acids of BetA/BAS3290 are about 81.3% identical, the corresponding amino acids of BAS4623 are about 50.0% identical, the corresponding amino acids of BclB are about 43.8% identical, the corresponding amino acids of BAS1882 are about 62.5% identical, the corresponding amino acids of the KBAB4 2280 gene product are about 81.3% identical, and the corresponding amino acids of the KBAB4 3572 gene product are about 81.3% identical. The sequence identities over this region for the remaining sequences are listed in FIGS. 1A and 1B.

With respect to amino acids 25-35 of BclA, the corresponding amino acids of BetA/BAS3290 are about 90.9% identical, the corresponding amino acids of BAS4623 are about 72.7% identical, the corresponding amino acids of BclB are about 54.5% identical, the corresponding amino acids of BAS1882 are about 72.7% identical, the corresponding amino acids of the KBAB4 2280 gene product are about 90.9% identical, and the corresponding amino acids of the KBAB4 3572 gene product are about 81.8% identical. The sequence identities over this region for the remaining sequences are listed in FIGS. 1A and 1B.

Thus, the targeting sequence can comprise an amino acid sequence having at least about 43% identity with amino acids 20-35 of SEQ ID NO: 1, wherein the identity with amino acids 25-35 is at least about 54%. Alternatively, the targeting sequence consists of an amino acid sequence consisting of 16 amino acids and having at least about 43% identity with amino acids 20-35 of SEQ ID NO: 1, wherein the identity with amino acids 25-35 is at least about 54%.

The targeting sequence can also comprise an amino acid sequence having at least about 50% identity with amino acids 20-35 of SEQ ID NO: 1, wherein the identity with amino acids 25-35 is at least about 63%. Alternatively, the targeting sequence consists of an amino acid sequence consisting of 16 amino acids and having at least about 50% identity with amino acids 20-35 of SEQ ID NO: 1, wherein the identity with amino acids 25-35 is at least about 63%.

The targeting sequence can also comprise an amino acid sequence having at least about 50% identity with amino acids 20-35 of SEQ ID NO: 1, wherein the identity with amino acids 25-35 is at least about 72%. Alternatively, the targeting sequence consists of an amino acid sequence consisting of 16 amino acids and having at least about 50% identity with amino acids 20-35 of SEQ ID NO: 1, wherein the identity with amino acids 25-35 is at least about 72%.

The targeting sequence can also comprise an amino acid sequence having at least about 56% identity with amino acids 20-35 of SEQ ID NO: 1, wherein the identity with amino acids 25-35 is at least about 63%. Alternatively, the targeting sequence consists of an amino acid sequence consisting of 16 amino acids and having at least about 56% identity with amino acids 20-35 of SEQ ID NO: 1, wherein the identity with amino acids 25-35 is at least about 63%.

The targeting sequence can comprise an amino sequence having at least about 62% identity with amino acids 20-35 of SEQ ID NO: 1, wherein the identity with amino acids 25-35 is at least about 72%. Alternatively, the targeting sequence can consist of an amino acid sequence consisting of 16 amino acids and having at least about 62% identity with amino acids 20-35 of SEQ ID NO: 1, wherein the identity with amino acids 25-35 of SEQ ID NO:1 is at least about 72%.

The targeting sequence can comprise an amino acid sequence having at least 68% identity with amino acids 20-35 of SEQ ID NO: 1, wherein the identity with amino acids 25-35 is at least about 81%. Alternatively, the targeting sequence consists of an amino acid sequence consisting of 16 amino acids and having at least 68% identity with amino acids 20-35 of SEQ ID NO: 1, wherein the identity with amino acids 25-35 is at least about 81%.

The targeting sequence can also comprises an amino sequence having at least about 75% identity with amino acids 20-35 of SEQ ID NO: 1, wherein the identity with amino acids 25-35 is at least about 72%. Alternatively, the targeting sequence consists of an amino acid sequence consisting of 16 amino acids and having at least about 75% identity with amino acids 20-35 of SEQ ID NO: 1, wherein the identity with amino acids 25-35 of SEQ ID NO:1 is at least about 72%.

The targeting sequence can also comprise an amino sequence having at least about 75% identity with amino acids 20-35 of SEQ ID NO: 1, wherein the identity with amino acids 25-35 is at least about 81%. Alternatively, the targeting sequence consists of an amino acid sequence consisting of 16 amino acids and having at least about 75% identity with amino acids 20-35 of SEQ ID NO: 1, wherein the identity with amino acids 25-35 of SEQ ID NO:1 is at least about 81%.

The targeting sequence can also comprise an amino acid sequence having at least about 81% identity with amino acids 20-35 of SEQ ID NO:1, wherein the identity with amino acids 25-35 is at least about 81%. Alternatively, the targeting sequence consists of an amino acid sequence consisting of 16 amino acids and having at least about 81% identity with amino acids 20-35 of SEQ ID NO:1, wherein the identity with amino acids 25-35 is at least about 81%.

The targeting sequence can comprise an amino acid sequence having at least about 81% identity with amino acids 20-35 of SEQ ID NO: 1, wherein the identity with amino acids 25-35 is at least about 90%. Alternatively, the targeting sequence consists of an amino acid sequence consisting of 16 amino acids and having at least about 81% identity with amino acids 20-35 of SEQ ID NO: 1, wherein the identity with amino acids 25-35 is at least about 90%.

The skilled person will recognize that variants of the above sequences can also be used as targeting sequences, so long as the targeting sequence comprises amino acids 20-35 of BclA, the corresponding amino acids of BetA/BAS3290, BAS4263, BclB, BAS1882, the KBAB4 2280 gene product, or the KBAB 3572 gene product, or a sequence comprising any of the above noted sequence identities to amino acids 20-35 and 25-35 of BclA is present.

Certain *Bacillus cereus* family exosporium proteins which lack regions having homology to amino acids 25-35 of BclA can also be used to target a peptide or protein to the exosporium of a *Bacillus cereus* family member. In particular, the fusion proteins can comprise an exosporium protein comprising SEQ ID NO: 108 (*B. mycoides* InhA), an exosporium protein comprising SEQ ID NO: 109 (*B. anthracis* Sterne BAS1141 (ExsY)), an exosporium protein comprising SEQ ID NO: 110 (*B. anthracis* Sterne BAS1144 (BxpB/ExsFA)), an exosporium protein comprising SEQ ID NO: 111 (*B. anthracis* Sterne BAS1145 (CotY)), an exosporium protein comprising SEQ ID NO: 112 (*B. anthracis* Sterne BAS1140), an exosporium protein comprising SEQ ID NO: 113 (*B. anthracis* H9401 ExsFB), an exosporium protein comprising SEQ ID NO: 114 (*B. thuringiensis* HD74 InhA1), an exosporium protein comprising SEQ ID NO: 115 (*B. cereus* ATCC 10876 ExsJ), an exosporium protein comprising SEQ ID NO: 116 (*B. cereus* ExsH), an exosporium protein comprising SEQ ID NO: 117 (*B. anthracis* Ames YjcA), an exosporium protein comprising SEQ ID NO: 118 (*B. anthracis* YjcB), an exosporium protein comprising SEQ ID NO: 119 (*B. anthracis* Sterne BclC), an exosporium protein comprising SEQ ID NO: 120 (*Bacillus thuringiensis* serovar konkukian str. 97-27 acid phosphatase), an exosporium protein comprising SEQ ID NO: 121 (*B. thuringiensis* HD74 InhA2), an exosporium protein comprising SEQ ID NO: 122 (*B. mycoides* InhA3), or an exosporium protein comprising SEQ ID NO: 381 (*B. anthracis* CotY variant). Inclusion of an exosporium protein comprising any of SEQ ID NOs: 108-122 or 381 in the fusion proteins described herein will result in targeting to the exosporium of a *B. cereus* family member.

Moreover, exosporium proteins having a high degree of sequence identity with any of the full-length exosporium proteins or the exosporium protein fragments described above can also be used to target a peptide or protein to the exosporium of a *Bacillus cereus* family member. Thus, the fusion protein can comprise an exosporium protein or exosporium protein fragment comprising an amino acid sequence having at least 85% identity with any one of SEQ ID NOs: 2, 4, 6, 8, 10, 12, 14, 16, 18, 20, 22, 24, 26, 28, 30, 32, 34, 36, 44, 46, 48, 50, 52, 54, 56, 58, 60, 62, 64, 66, 68, 70, 72, 74, 76, 78, 80, 82, 84, 86, 88, 90, 92, 94, 95, 108, 109, 110, 111, 112, 113, 114, 115, 116, 117, 118, 119, 120, 121, 122, and 381.

Alternatively, the fusion protein can comprise an exosporium protein having at least 90% identity with any one of SEQ ID NOs: 2, 4, 6, 8, 10, 12, 14, 16, 18, 20, 22, 24, 26, 28, 30, 32, 34, 36, 44, 46, 48, 50, 52, 54, 56, 58, 60, 62, 64, 66, 68, 70, 72, 74, 76, 78, 80, 82, 84, 86, 88, 90, 92, 94, 95, 108, 109, 110, 111, 112, 113, 114, 115, 116, 117, 118, 119, 120, 121, 122, and 381.

The fusion protein can comprise an exosporium protein having at least 95% identity with any one of SEQ ID NOs: 2, 4, 6, 8, 10, 12, 14, 16, 18, 20, 22, 24, 26, 28, 30, 32, 34, 36, 44, 46, 48, 50, 52, 54, 56, 58, 60, 62, 64, 66, 68, 70, 72, 74, 76, 78, 80, 82, 84, 86, 88, 90, 92, 94, 95, 108, 109, 110, 111, 112, 113, 114, 115, 116, 117, 118, 119, 120, 121, 122, and 381.

The fusion protein can comprise an exosporium protein having at least 98% identity with any one of SEQ ID NOs: 2, 4, 6, 8, 10, 12, 14, 16, 18, 20, 22, 24, 26, 28, 30, 32, 34, 36, 44, 46, 48, 50, 52, 54, 56, 58, 60, 62, 64, 66, 68, 70, 72, 74, 76, 78, 80, 82, 84, 86, 88, 90, 92, 94, 95, 108, 109, 110, 111, 112, 113, 114, 115, 116, 117, 118, 119, 120, 121, 122, and 381.

The fusion protein can comprise an exosporium protein having at least 99% identity with any one of SEQ ID NOs: 2, 4, 6, 8, 10, 12, 14, 16, 18, 20, 22, 24, 26, 28, 30, 32, 34, 36, 44, 46, 48, 50, 52, 54, 56, 58, 60, 62, 64, 66, 68, 70, 72, 74, 76, 78, 80, 82, 84, 86, 88, 90, 92, 94, 95, 108, 109, 110, 111, 112, 113, 114, 115, 116, 117, 118, 119, 120, 121, 122, and 381.

The fusion protein can comprise an exosporium protein having 100% identity with any one of SEQ ID NOs: 2, 4, 6, 8, 10, 12, 14, 16, 18, 20, 22, 24, 26, 28, 30, 32, 34, 36, 44, 46, 48, 50, 52, 54, 56, 58, 60, 62, 64, 66, 68, 70, 72, 74, 76, 78, 80, 82, 84, 86, 88, 90, 92, 94, 95, 108, 109, 110, 111, 112, 113, 114, 115, 116, 117, 118, 119, 120, 121, 122, and 381.

Any of the targeting sequences, exosporuim proteins, or exosporium protein fragments can be used to target any protein or peptide of interest, including, but not limited to, the enzymes and expansin proteins described herein, to the exosporium of a recombinant *Bacillus cereus* family member.

For example, any of the targeting sequences, exosporium proteins, or exosporium protein fragments (e.g., any of SEQ ID NOs. 381-385) can be used to target a protein or peptide of interest (e.g., an endoglucanase such as the endoglucanase of SEQ ID NO: 293; a phospholipase such as the phospholipase of SEQ ID NO: 250; a xyloglucanase such as the xyloglucanase of SEQ ID NO: 300; a protease such as the protease of SEQ ID NO: 303 or 304; or an ACC deaminase such as the ACC deaminase of SEQ ID NO: 249) to the exosporium of a recombinant *Bacillus cereus* family member.

During sporulation of a recombinant *Bacillus cereus* family member expressing any of the fusion proteins described herein, the targeting motif, exosporium protein, or exosporium protein fragment is recognized by the spore exosporium assembly machinery and directed to the exosporium, resulting in display of the protein or peptide of interest portion of the fusion protein (e.g., the enzyme having ACC deaminase activity, the phospholipase, the lipase, the xylanase, the xylosidase, the lactonase, the chitosanase, the protease, the glucanase, the phytase, the acid phosphatase, the pectinase, the mannanase, or the expansin protein) on the outside of the spore.

As illustrated further by the Examples provided hereinbelow, the use of different targeting sequences allows for control of the expression level of the fusion protein on the surface of the *Bacillus cereus* family member spore. Use of certain of the targeting sequences described herein will result in a higher level of expression of the fusion protein, whereas use of others of the targeting sequences will result in lower levels of expression of the fusion protein on the surface of the spore.

In any of the fusion proteins described herein, the targeting sequence, exosporium protein, or exosporium protein fragment can comprise the amino acid sequence GXT at its carboxy terminus, wherein X is any amino acid.

In any of the fusion proteins described herein, the targeting sequence, exosporium protein, or exosporium protein fragment, can comprise an alanine residue at the position of the targeting sequence that corresponds to amino acid 20 of SEQ ID NO: 1.

In any of the fusion proteins described herein, the targeting sequence, exosporium protein, or exosporium protein fragment can further comprise a methionine, serine, or threonine residue at the amino acid position immediately preceding the first amino acid of the targeting sequence, exosporium protein, or exosporium protein fragment or at the position of the targeting sequence that corresponds to amino acid 20 of SEQ ID NO: 1.

B. ACC Deaminases, Phospholipases, Lipases, Xylanases, Xylosidases, Lactonases, Chitosanases, Proteases, Glucanases, Phytases, Acid Phosphatases, Pectinases, Mannanases, and Expansin Proteins The fusion proteins can comprise an enzyme having ACC deaminase activity, a phospholipase, a lipase, a xylanase, a xylosidase, a lactonase, a chitosanase, a protease, a glucanase, a phytase, an acid phosphatase, a pectinase, a mannanase, and/or an expansin protein. For ease of reference, illustrative sequences for wild-type and modified ACC deaminase enzymes, as well as sequences for the other enzymes and the expansin proteins that can be used in connection with the fusion proteins, recombinant *Bacillus cereus* family members, exosporium fragments, formulations, seeds, and methods described herein, are provided below.

1. D-Cysteine Desulfhydrases and ACC Deaminases

The fusion proteins can comprise an enzyme having ACC deaminase activity. ACC deaminases and D-cysteine desulfhydrases (DCD) often have similar amino acid sequences and can have overlapping enzyme activities, being able to act on both 1-aminocyclopropane-1-carboxylate (ACC) and D-cysteine as substrates. Some enzymes only have one of these activities, while others are able to act both as ACC deaminases and as D-cysteine desulfhydrases. ACC deaminases cleave ACC into ammonia and alpha-ketobutyrate, while D-cysteine desulfhydrases converts D-cysteine into pyruvate, $H_2S$, and ammonia. ACC is the immediate precursor of ethylene, which can cause undesirable effects in plants if present at high levels.

Thus, an enzyme having increased ACC deaminase activity would be beneficial for use in agriculture in order to reduce ACC levels and thereby reduce ethylene levels. Application of ACC deaminase to a plant growth medium, a plant, a plant seed, or an area surrounding a plant or a plant seed can stimulate plant growth, promote plant health (e.g., by increasing nutrient uptake), and slow fruit ripening. These effects in turn lead to increased yields, early season vigor, and resistance of plants to early season stresses. ACC deaminases can also protect plants from pathogens as well as abiotic stresses.

As explained in greater detail below, mutations can be made in enzymes that exhibit D-cysteine desulfhydrase and/or ACC deaminase activity in order to increase the ACC deaminase activity of the enzyme. All plants make ACC and respond to ethylene, and thus such modified ACC deaminase enzymes have broad applicability.

Naturally occurring ACC deaminase is not a secreted protein. ACC deaminases are found in many types of microorganisms, including bacteria of the Phyla Bacteriodetes, Firmicutes, and Actinobacteria, and bacteria of the genera *Pseudomonas, Bacillus, Rhizobium, Bradyrhizobium*, as well as many others. However, the ACC deaminases found in these bacteria are intracellular, and have limited exposure to the substrate ACC from the host plants that they colonize. Display of an enzyme having ACC deaminase activity on the outside of *Bacillus cereus* family member spores using the BEMD system described herein allows for increased contact between the enzyme and its substrate upon application of the spores to a plant growth medium, a plant, a plant seed, or an area surrounding a plant or a plant seed.

For ease of reference, illustrative D-cysteine desulfhydrase and 1-aminocyclopropane-1-carboxylate deaminase (ACC deaminase) nucleotide sequences are provided in Table 2 below, together with their SEQ ID NOs. Table 3 below provides the corresponding amino acid sequences for the nucleotide sequences listed in Table 2. Mutation of certain amino acids in a wild-type D-cysteine desulfhydrase or ACC deaminase enzyme can result in an enzyme having increased ACC deaminase activity as compared to the ACC deaminase activity of the wild-type enzyme under the same conditions.

In Table 2, SEQ ID NOs. 234-237 are nucleotide sequences for wild-type enzymes that exhibit both ACC deaminase and D-cysteine desulfhydrase activity, and SEQ ID NOs. 238-241 are nucleotide sequences that code for corresponding versions of these enzymes having two amino acid substitutions relative to the wild-type sequence that result in increased ACC deaminase activity. Thus, for example, SEQ ID NO: 234 provides the nucleotide sequence for a wild-type enzyme, and SEQ ID NO: 238 provides the nucleotide sequence for the same enzyme wherein the nucleotide sequence has been altered to encode an enzyme having two amino acid substitutions relative to the enzyme encoded by SEQ ID NO: 234. Similarly, SEQ ID NO: 235 provides the nucleotide sequence for a wild-type enzyme, and SEQ ID NO: 239 provides the nucleotide sequence for the same enzyme wherein the nucleotide sequence has been altered to encode an enzyme having two amino acid substitutions relative to the enzyme encoded by SEQ ID NO: 235. Likewise, SEQ ID NO: 236 is a wild-type sequence and SEQ ID NO: 240 provides the corresponding altered sequence, and SEQ ID NO 237 is a wild-type sequence and SEQ ID NO: 241 provides the corresponding altered sequence.

In Table 3, SEQ ID NOs. 242-245 are amino acid sequences for wild-type enzymes that exhibit both ACC deaminase and D-cysteine desulfhydrase activity, and SEQ ID NOs. 246-249 are amino acid sequences for the corresponding versions of these enzymes having two amino acid substitutions relative to the wild-type sequence that result in increased enzyme activity. Thus, SEQ ID NO: 242 is a wild-type sequence and SEQ ID NO: 246 provides the amino acid sequence for the same enzyme having the two amino acid substitutions relative to the wild-type sequence. SEQ ID NOs. 243 and 247, 244 and 248, and 245 and 249 are related to one another in the same manner. The substituted amino acids are shown in SEQ ID NOs. 246-249 in Table 3 in bold and underlined text.

TABLE 2

Nucleotide sequences for D-cysteine desulfhydrases and ACC deaminases

| Enzyme | SEQ ID NO. |
|---|---|
| D-Cysteine Desulfhydrase (ACC deaminase native 1b) (*Bacillus thuringiensis*, wild-type) | 234 |
| D-Cysteine Desulfhydrase (ACC deaminase native 2b) (*Bacillus pseudomycoides*, wild-type) | 235 |
| D-Cysteine Desulfhydrase (ACC deaminase native 3b) (*Bacillus thuringiensis*, wild-type) | 236 |
| D-Cysteine Desulfhydrase (ACC deaminase) (ID CODE: E195) (*Bacillus thuringiensis*, wild-type) | 237 |
| D-Cysteine Desulfhydrase (ACC deaminase native 1b) (*Bacillus thuringiensis*, with mutations) | 238 |
| D-Cysteine Desulfhydrase (ACC deaminase native 2b) (*Bacillus pseudomycoides*, with mutations) | 239 |
| D-Cysteine Desulfhydrase (ACC deaminase native 3b) (*Bacillus thuringiensis*, with mutations) | 240 |
| ACC deaminase (D-Cysteine Desulfhydrase) (ID CODE: D406) (*Bacillus thuringiensis*, with mutations) | 241 |

TABLE 3

Amino acid sequences for D-cysteine desulfhydrases and ACC deaminases

| Enzyme (SEQ ID NO) | Amino acid sequence |
|---|---|
| D-Cysteine Desulfhydrase (ACC deaminase native 1b) Wild-type *Bacillus thuringiensis* (SEQ ID NO: 242) | MNLAKFPRKKYTESYTPIEKLNNFSEALGGPTIYFKRDDLLGLTA GGNKTRKLEFLVADAEAKGADTLITAGGIQSNHCRLTLAAAVKE KMKCILVLEEGLEPEEKPDFNGNYFLYHLLGAENVIVVPNGADL MEEMHKVAKEVSEKGNTPYVIPVGGSNPTGAMGYVACAQEIM AQSFDQGIDFSTVVCVSGSAGMHAGLITGFAGTQSHIPVIGINVS RGKAEQEEKVAKLVDETSAHVGIPNFIPRDAVTCFDEYVGPGYA LPTPEMVEAVQLLAKTEGILLDPVYTGKAVAGLIDLIKKGTFNKE DNILFVHSGGSPALYANTSLFA |

TABLE 3 -continued

| Amino acid sequences for D-cysteine desulfhydrases and ACC deaminases | |
|---|---|
| Enzyme (SEQ ID NO) | Amino acid sequence |
| D-Cysteine Desulfhydrase<br>(ACC deaminase native 2h)<br>Wild-type<br>*Bacillus pseudomycoides*<br>(SEQ ID NO: 243) | MNLAKFPRKKYTESYTPIEKLNHFSEVLGGPSIYFKRDDLLGLTA<br>GGNKTRKLEFLVADAQAKGVDTLITAGGIQSNHCRLTLAAAVK<br>EKMKCILVLEEGLEPEEKPDFNGNYFLYHLLGAENVIVVPNGTD<br>LMDEMQKVAKEVTEKGHTPYVIPVGGSNPTGAMGYIACAEEIM<br>AQSFEQGIDFNAVVCVSGSGGMHAGLITGFYGRQTGIPIIGMNVS<br>RGKAEQEEKVCKLVQETSAHVGIPNSIPREAVTCFDEYVGPGYA<br>LPTPEMVEAVQLLAKTEGILLDPVYTGKAVAGLIDIIRKGTFKKE<br>DNILFVHSGGSPALYANTSLFS |
| D-Cysteine Desulfhydrase<br>(ACC deaminase native 3h)<br>Wild-type<br>*Bacillus thuringiensis*<br>(SEQ ID NO: 244) | MNLAKFPRKKYTESYTPIEKLNNFSEVLGGPTIYFKRDDLLGLTA<br>GGNKTRKLEFLVADAQAKGADTLITAGGIQSNHCRLTLAAAVK<br>EKMKCILVLEEGLEPEEKPDFNGNYFLYHLLGAENVIVVPNGAD<br>LMEEMHKVAKEVSEKGNTPYVIPVGGSNPTGAMGYVACAQEIMA<br>QSFEQGIDFSSVVCVSGSGGMHAGLITGFAGTQSHIPVIGINVSR<br>GKAEQEEKVAKLVDETSAHVGIPNFISRDAVTCFDQYVGPGYAL<br>PTQEMVEAVQLLAKTEGILLDPVYTGKAVAGLIDLIKKGTFNKE<br>DNILFVHSGGSPALYANTSLFA |
| D-Cysteine Desulfhydrase<br>(ACC deaminase)<br>*Bacillus thuringiensis*<br>Wild-type<br>(ID CODE: E195)<br>(SEQ ID NO: 245) | MNLAKFPRKKYTESYTPIEKLNNFSEALGGPTIYFKRDDLLGLTA<br>GGNKTRKLEFLVADAQEKGADTLITAGGIQSNHCRLTLAAAVKE<br>KMKCILVLEEGLEPEEKRDFNGNYFLYHLLGAENVIVVPNGADL<br>MEEMNKVAKEVSEKGSTPYVIPVGGSNPTGAMGYVACAQEIMAQ<br>SFEQGIDFSSVVCVSGSGGMHAGLITGFSGTQSHIPVIGINVSRG<br>KAEQEEKVAKLVDETSAHVGIPNFISRDAVTCFDEYVGPGYALP<br>TPEMVEAVQLLAKTEGILLDPVYTGKAVAGLIDLIRKGKFNKED<br>NILFVHSGGSPALYANTSLFA |
| D-Cysteine Desulfhydrase<br>(ACC deaminase native 1b)<br>With mutations<br>*Bacillus thuringiensis*<br>(SEQ ID NO: 246) | MNLAKFPRKKYTESYTPIEKLNNFSEALGGPTIYFKRDDLLGLTA<br>GGNKTRKLEFLVADAEAKGADTLITAGGIQSNHCRLTLAAAVKE<br>KMKCILVLEEGLEPEEKPDFNGNYFLYHLLGAENVIVVPNGADL<br>MEEMHKVAKEVSEKGNTPYVIPVGGSNPTGAMGYVACAQEIM<br>AQSFDQGIDFSTVVCVSGSAGMHAGLITGFAGTQSHIPVIGINVS<br>RGKAEQEEKVAKLVDETSAHVGIPNFIPRDAVTCFDEYVGPGYA<br>LPTPEMVEAVQLLAKTEGILLDPVYEGKAVAGLIDLIKKGTFNK<br>EDNILFVHLGGSPALYANTSLFA |
| D-Cysteine Desulfhydrase<br>(ACC deaminase native 2b)<br>With mutations<br>*Bacillus pseudomycoides*<br>(SEQ ID NO: 247) | MNLAKFPRKKYTESYTPIEKLNHFSEVLGGPSIYFKRDDLLGLTA<br>GGNKTRKLEFLVADAQAKGVDTLITAGGIQSNHCRLTLAAAVK<br>EKMKCILVLEEGLEPEEKPDFNGNYFLYHLLGAENVIVVPNGTD<br>LMDEMQKVAKEVTEKGHTPYVIPVGGSNPTGAMGYIACAEEIM<br>AQSFEQGIDFNAVVCVSGSGGMHAGLITGFYGRQTGIPIIGMNVS<br>RGKAEQEEKVCKLVQETSAHVGIPNSIPREAVTCFDEYVGPGYA<br>LPTPEMVEAVQLLAKTEGILLDPVYEGKAVAGLIDIIRKGTFKKE<br>DNILFVHLGGSPALYANTSLFS |
| D-Cysteine Desulfhydrase<br>(ACC deaminase native 3b)<br>With mutations<br>*Bacillus thuringiensis*<br>(SEQ ID NO: 248) | MNLAKFPRKKYTESYTPIEKLNNFSEVLGGPTIYFKRDDLLGLTA<br>GGNKTRKLEFLVADAQAKGADTLITAGGIQSNHCRLTLAAAVK<br>EKMKCILVLEEGLEPEEKPDFNGNYFLYHLLGAENVIVVPNGAD<br>LMEEMHKVAKEVSEKGNTPYVIPVGGSNPTGAMGYVACAQEIMA<br>QSFEQGIDFSSVVCVSGSGGMHAGLITGFAGTQSHIPVIGINVSR<br>GKAEQEEKVAKLVDETSAHVGIPNFISRDAVTCFDQYVGPGYAL<br>PTQEMVEAVQLLAKTEGILLDPVYEGKAVAGLIDLIKKGTFNKE<br>DNILFVHLGGSPALYANTSLFA |
| ACC deaminase<br>(D-Cysteine Desulfhydrase)<br>*Bacillus thuringiensis*,<br>with mutations)<br>(ID CODE: D406)<br>(SEQ ID NO: 249) | MNLAKFPRKKYTESYTPIEKLNNFSEALGGPTIYFKRDDLLGLTA<br>GGNKTRKLEFLVADAQEKGADTLITAGGIQSNHCRLTLAAAVKE<br>KMKCILVLEEGLEPEEKRDFNGNYFLYHLLGAENVIVVPNGADL<br>MEEMNKVAKEVSEKGSTPYVIPVGGSNPTGAMGYVACAQEIMAQ<br>SFEQGIDFSSVVCVSGSGGMHAGLITGFSGTQSHIPVIGINVSRG<br>KAEQEEKVAKLVDETSAHVGIPNFISRDAVTCFDEYVGPGYALP<br>TPEMVEAVQLLAKTEGILLDPVYEGKAVAGLIDLIRKGKFNKED<br>NILFVHLGGSPALYANTSLFA |

2. Phospholipases

Phospholipases are enzymes that cleave phospholipids. Different types of phospholipases cleave phospholipids at different positions. Phospholipases A1, A2 and B cleave the SN-1 and/or SN-2 acyl chains, resulting in the release of fatty acids and lysophospholipids. Phospholipase C (PLC) and phospholipase D (PLD) act on the head group of the phospholipid instead. PLCs cleave phospholipids into diacylglycerides and head group phosphates. PLDs cleave phospholipids into phosphatidic acid and the head group. Many phospholipases are membrane-associated. However, some phospholipases are secreted and others are localized intracellularly. Phospholipases in general play important roles in signal transduction pathways and can be found in a wide range of organisms, including bacteria, yeast, plants, animals and viruses.

Phospholipase C (EC 3.1.4.3) cleaves phospholipids just prior to the phosphate group into diacylglycerols and the corresponding head group phosphates. Phospholipase C is characterized by the site of cleavage on the phospholipid (the phosphorous-oxygen bond on the carbon chain side of the phosphate head), which distinguishes it from other phospholipases. General activators of the PLC class of enzymes typically include heterotrimeric G protein subunits, protein tyrosine kinases, small G proteins, calcium ($Ca^{2+}$), and phospholipids.

Phospholipase D (EC 3.1.4.4) is another enzyme of the phospholipase superfamily. The principal substrate of phospholipase D (PLD) is phosphatidylcholine, which is hydrolyzed to produce a signal molecule phosphatidic acid and soluble choline. Phospholipase D is involved in membrane trafficking, cytoskeletal reorganization, receptor-mediated endocytosis, exocytosis and cell migration.

In soil, phospholipases can break down phospholipids naturally the soil (e.g., phospholipids from plant debris and/or lysed microbes), and release fatty acids and phospholipid head groups. The phospholipid head groups act as natural reservoirs of excess phosphate, which is a valuable extractable nutrient for both plants and microbes, and the conversion of phospholipids to phosphatidic acid by phospholipases is the first step before the phosphate group can be released from the molecule.

In addition, plants secrete phospholipids from the root cap during development of roots into the rhizosphere. These phospholipids, together with complex polysaccharides and monosaccharides, recruit beneficial microbes and fungi to the plant roots/rhizosphere and also provide a nutrient source for the microbes. Plants also use the secreted phospholipids as natural secreted surfactants, which allows the plant access to additional nutrients that are bound to the soil, such as phosphate. Conversion of phospholipids to phosphatidic acid maintains the surfactant properties while simultaneously allowing for release of nutrients into the soil.

Phospholipases can be used for any of the plant growth stimulating or plant health promoting purposes described herein, but are especially suitable for stimulating plant growth, increasing nutrient uptake, and/or increasing root development and nodulation. Increasing root nodulation enhances the ability of the plant to form symbiotic relationships with nitrogen fixing microorganisms in the soil, resulting in increased nitrogen uptake and enhanced growth rates. These effects also lead to decreased susceptibility to environmental stresses such as drought.

For ease of reference, illustrative phospholipase amino acid sequences are provided in Table 4 below, together with their SEQ ID NOs.

TABLE 4

Amino acid sequences for phospholipases

| Enzyme (SEQ ID NO) | Amino acid sequence |
| --- | --- |
| Phospholipase C<br>Bacillus thuringiensis<br>(ID CODE: E143)<br>(SEQ ID NO: 250) | HENDGGQRFGVIPRWSAEDKHKEGVNSHLWIVNRAIDIMSRNTT<br>LVKQDRVALLNEWRTELENGIYAADYENPYYDNSTFASHFYDP<br>DNGKTYIPYAKQAKETGAKYFKLAGESYKNKDMQQAFFYLGLS<br>LHYLGDVNQPMHAANFTNLSYPQGFHSKYENFVDTIKDNYKVT<br>DGNGYWNWKGTNPEDWIHGAAVVAKQDYAGIVNDNTKDWFV<br>RAAVSQEYADKWRAEVTPMTGKRLMDAQRVTAGYIQLWFDTY<br>GDR |
| Phospholipase C<br>Bacillus thuringiensis<br>(without propeptide)<br>(ID CODE: E144)<br>(SEQ ID NO: 251) | SAEDKHKEGVNSHLWIVNRAIDIMSRNTTLVKQDRVALLNEWR<br>TELENGIYAADYENPYYDNSTFASHFYDPDNGKTYIPYAKQAKE<br>TGAKYFKLAGESYKNKDMQQAFFYLGLSLHYLGDVNQPMHAA<br>NFTNLSYPQGFHSKYENFVDTIKDNYKVTDGNGYWNWKGTNPE<br>DWIHGAAVVAKQDYAGIVNDNTKDWFVRAAVSQEYADKWRA<br>EVTPMTGKRLMDAQRVTAGYIQLWFDTYGDR |
| Phospholipase C<br>(Zinc dependent<br>phospholipase C (alpha<br>toxin))<br>Bacillus thuringiensis<br>serovar israelensis 4Q7<br>(SEQ ID NO: 252) | HENDGGQRFGVIPRWSAEDKHKEGVNSHLWIVNRAIDIMSRNTT<br>LVKQDRVALLNEWRTELENGIYAADYENPYYDNSTFASHFYDP<br>DNGKTYIPYAKQAKETGAKYFKLAGESYKNKDMKQAFFYLGLS<br>LHYLGDVNQPMHAANFTNLSYPQGFHSKYENFVDTIKDNYKVT<br>DGNGYWNWKGTNPEDWIHGAAVVAKQDYAGIVNDNTKDWFV<br>RAAVSQEYADKWRAEVTPMTGKRLMDAQRVTAGYIQLWFDTY<br>GNR |
| Phospholipase C<br>((nSMase) hydrolysis<br>of sphingomyelin to<br>ceramide and<br>phosphorylcholine)<br>Bacillus<br>thuringiensis serovar<br>israelensi 4Q7<br>(SEQ ID NO: 253) | ASTNQNDTLKVMTHNVYMLSTNLYPNWGQTERADLIGAADYIK<br>NQDVVILNEVFDNSASDRLLGNLKKEYPNQTAVLGRSSGSEWD<br>KKLGNYSSSTPEDGGVAIVSKWPIAEKIQYVFAKGCGPDNLSNK<br>GFVYTKIKKNDRFIHVIGTHLQAEDSMCGKTSPASVRTNQLKEIQ<br>DFIKNKNIPNNEYVLIGGDMNVNKINAENKNDSEYTSMFKTLNA<br>SVPSYTGHTATWDATTNSIAKYNFPDSPAEYLDYIIASKDHANPS<br>YIENKVLQPKSPQWTVTSWFQKYTYNDYSDHYPVEATISMK |
| Phospholipase C (Zinc<br>dependent phospholipase<br>C (alpha toxin))<br>Bacillus cereus ATCC<br>10987<br>(SEQ ID NO 254) | HENDGGSKIKIVHRWSAEDKHKEGVNSHLWIVNRAIDIMSRNTT<br>LVKQDRVAQLNEWRTELENGIYAADYENPYYDNSTFASHFYDP<br>DNGKTYIPFAKQAKETGAKYFKLAGESYKNKDMKQAFFYLGLS<br>LHYLGDVNQPMHAANFTNLSYPQGFHSKYENFVDTIKDNYKVT<br>DGNGYWNWKGTNPEEWIHGAAVVAKQDYSGIVNDNTKDWFV<br>KAAVSQEYADKWRAEVTPMTGKRLMDAQRVTAGYIQLWFDTY<br>GDR |

TABLE 4 -continued

Amino acid sequences for phospholipases

| Enzyme (SEQ ID NO) | Amino acid sequence |
|---|---|
| Phospholipase C<br>Clostridium perfringens<br>str 13<br>(C. welchii) Type I<br>(SEQ ID NO: 255) | DGKIDGTGTHAMIVTQGVSILENDLSKNEPESVRKNLEILKENM<br>HELQLGSTYPDYDKNAYDLYQDHFWDPDTDNNFSKDNSWYLA<br>YSIPDTGESQIRKFSALARYEWQRGNYKQATFYLGEAMHYFGDI<br>DTPYHPANVTAVDSAGHVKFETFAEERKEQYKINTAGCKTNEDF<br>YADILKNKDFNAWSKEYARGFAKTGKSIYYSHASMSHSWDDW<br>DYAAKVTLANSQKGTAGYIYRFLHDVSEGNDPSVGKNVKELVA<br>YISTSGEKDAGTDDYMYFGIKTKDGKTQEWEMDNPGNDFMTGS<br>KDTYTFKLKDENLKIDDIQNMWIRKRKYTAFPDAYKPENIKIIAN<br>GKVVVDKDINEWISGNSTYNIK |
| Phospholipase D pld55<br>Streptomyces chromofuscus<br>(ID CODE: D409)<br>(SEQ ID NO: 256) | TTGTPAFLHGVASGDPLPDGVLLWTRVTPTADATPGSGLGPDTE<br>VGWTVATDKAFTNVVAKGSTTATAASDHTVKADIRGLAPATDH<br>WFRFSAGGTDSPAGRARTAPAADAAVAGLRFGVVSCANWEAG<br>YFAAYRHLAARGDLDAWLHLGDYIYEYGAGEYGTRGTSVRSH<br>APAHEILTLADYRVRHGRYKTDPDLQALHAAAPVVAIWDDHEI<br>ANDTWSGGAENHTEGVEGAWAARQAAAKQAYFEWMPVRPAI<br>AGTTYRRLRFGKLADLSLLDLRSFRAQQVSLGDGDVDDPDRTLT<br>GRAQLDWLKAGLKSSDTTWRLVGNSVMIAPFAIGSLSAELLKPL<br>AKLLGLPQEGLAVNTDQWDGYTDDRRELLAHLRSNAIRNTVFL<br>TGDIHMAWANDVPVNAGTYPLSASAATEFVVTSVTSDNLDDLV<br>KVPEGTVSALASPVIRAANRHVHWVDTDRHGYGVLDITAERAQ<br>MDYYVLSDRTQAGATASWSRSYRTRSGTQRVERTYDPE |
| Phosphatidylcholine-<br>specific phospholipase C<br>Bacillus cereus<br>(SEQ ID NO: 257) | HENDGGSKIKIVHRWSAEDKHKEGVNSHLWIVNRAIDIMSRNKT<br>LVKQDRVALLNEWRTELENGIYAADYENPYYDNSTFASHFYDP<br>DNGKTYIPYAKQAKETGAKYFKLAGESYKNKDMKQAFFYLGLS<br>LHYLGDVNQPMHAANFTNLSYPQGFHSKYENFVDTIKDNYKVT<br>DGNGYWNWKGTNPEDWIHGAAVVAKQDYAGIVNDNTKDWFV<br>RAAVSQEYADKWRAEVTPMTGKRLMDAQRVTAGYIQLWFDTY<br>GDR |
| Phosphatidylinositol-<br>specific phospholipase C<br>Bacillus cereus<br>(SEQ ID NO: 258) | MRNKKLILKLFICSTIFITFVFALHDKRVVAASSVNELENWSKW<br>MQPIPDNIPLARISIPGTHDSGTFKLQNPIKQVWGMTQEYDFRYQ<br>MDHGARIFDIRGRLTDDNTIVLHHGPLYLYVTLHEFINEAKQFLK<br>DNPSETIIMSLKKEYEDMKGAENSFSSTFEKNYFVDPIFLKTEGN<br>IKLGDARGKIVLLKRYSGSNESGGYNNFYWPDNETFTTTVNKNV<br>NVTVQDKYKVSYDEKVKSIKDTINETMNNSEDLNHLYINFTSLS<br>SGGTAWNSPYYYASYINPEIAAYIKQENPKRVGWVIQDYISDKW<br>SPILYQEVIRTNKSL |
| Phospholipase D (PLD)<br>Acidovorax avenae<br>(SEQ ID NO: 259) | MSGGHRVALLQGSAELFSALVADMDAALSDIQFETYIFDCTGSG<br>ADIAEALIRAARRGVRVHLVVDGVGTGRLCSPWPERFEEAGVR<br>MQVYSPLGPLGLLLPRRWRRLHRKLCVVDGCVLYCGGINVLDD<br>LHDPNHGALESPRFDFAVRVEGRLVEEAGEAMEQVWWRLQAT<br>RDARQRRLADLMCDLRAAAQARQAERLAREAAPGGAAAAHGL<br>RAGLLLRDNLRNRSRIERAYRRAIGNARHEVIIANAYFLPGRKLR<br>HALVLAARRGVRVRLLLQGRYEYFMQYHAARPVYGALLAAGV<br>EIHEYAPSFLHAKVAVIDAQGEHPWATVGSSNLDPLSMLLAREA<br>NVVVEDAGFARALRARLVDAMEHAGRQLDPQAYGARPWGQR<br>LRDRVAFALMRLALWVTGSRY |
| Phospholipase D clsB<br>Bacillus licheniformis<br>(ID CODE: E229)<br>(SEQ ID NO: 260) | MVPLMIMVCFLILLLALDFHFGRKAFEKKAYEPVFSEKKSDIELI<br>HNGEDLCERLLDDIRQAESSVHVMFYIVKNDDISLEFLKVLDK<br>AKSGVCVRLLIDRIGAMKVKKKTLSGLKQSGVHVFFANKPGFPY<br>FFYRLNARNHRKIAVIDGKIGYVGGFNIAKEYLGKKAEFGPWKD<br>YHLRMTGEGVADLQHIFISDFKREAPQAKPANSVFPPLQQGAVT<br>HTTHATKGFSLEEKYISFIEQAKERIMICTPYYIPSPALQQAVLS<br>ARERGVIVSVLVPMKPDHPLVKEAAYTHFPALLKAGCYIYRYRG<br>FYHAKALIVDDRHVMIGTSNFDNRSLFLNDEVNVVIHDKDWTK<br>QFFDVVKESIEHAELLTKERYAKRPVMQRPVEWLAKSISFFL |
| Phospholipase C<br>Listeria monocytogenes<br>(ID CODE: D474)<br>(SEQ ID NO: 373) | <u>CCDEYLQTPAAPHDIDSKLPHKLSWSADNPTNTDVNTHYWLFK</u><br>QAEKILAKDVNHMRANLMNELKKFDKQIAQGIYDADHKNPYY<br>DTSTFLSHFYNPDRDNTYLPGFANAKITGAKYFNQSVTDYREGK<br>FDTAFYKLGLAIHYYTDISQPMHANNFTAISYPPGYHCAYENYV<br>DTIKHNYQATEDMVAKRFCSDDVKDWLYENAKRAKADYPKIV<br>NAKTKKSYLVGNSEWKKDTVEPTGARLRDSQQTLAGFLEFWSK<br>KTNE |
| Phospholipase C<br>Listeria monocytogenes<br>(without propeptide)<br>(ID CODE: D475)<br>(SEQ ID NO: 374) | WSADNPTNTDVNTHYWLFKQAEKILAKDVNHMRANLMNELKK<br>FDKQIAQGIYDADHKNPYYDTSTFLSHFYNPDRDNTYLPGFANA<br>KITGAKYFNQSVTDYREGKFDTAFYKLGLAIHYYTDISQPMHAN<br>NFTAISYPPGYHCAYENYVDTIKHNYQATEDMVAKRFCSDDVK<br>DWLYENAKRAKADYPKIVNAKTKKSYLVGNSEWKKDTVEPTG<br>ARLRDSQQTLAGFLEFWSKKTNE |

TABLE 4 -continued

Amino acid sequences for phospholipases

| Enzyme (SEQ ID NO) | Amino acid sequence |
|---|---|
| Phosphatidylinositol-specific Phospholipase C Bacillus thuringiensis (SEQ ID NO: 375) | ASSVNELENWSKWMQPIPDNIPLARISIPGTHDSGTFKLQNPIKQ VWGMTQEYDFRYQMDHGARIFDIRGRLTDDNTIVLHHGPLYLY VTLHEFINEAKQFLKDNPSETIIMSLKKEYEDMKGAEDSFSSTFE KNYFVDPIFLKTEGNIKLGDARGKIVLLKRYSGSNESGGYNNFY WPDNETFTTTVNKNVNVTVQDKYKVSYDEKVKSIKDTINETMN NSEDLNHLYINFTSLSSGGTAWNSPYYYASYINPEIAAYIKQENP KRVGWVIQDYISDKWSPILYQEVIRANKSLIKE |

The native amino acid sequences of the phospholipases of SEQ ID NOs. 250 and 252 include the signal peptide sequence MKKKVLALAAAITLVAPLQSVAFA (SEQ ID NO: 317) at the amino-terminus of the sequence, immediately preceding the first amino acid of SEQ ID NOs. 250 and 252. This signal peptide is not included in SEQ ID NOs. 250 and 252. However, the signal peptide of SEQ ID NO: 317, or another signal peptide, can optionally be included at the amino-terminus of the phospholipases of SEQ ID NO: 250 or 252, or at the amino-terminus of any of the other enzymes or expansin proteins described herein. Where the signal peptide of SEQ ID NO: 317 is included at the amino terminus of the phospholipase of SEQ ID NO: 250, this enzyme is referred to herein by ID Code E95, E62, or E80.

The native amino acid sequence of the phospholipase of SEQ ID NO: 250 also includes a propeptide (HENDGGQRFGVIPRW, SEQ ID NO: 261). This propeptide is underlined in the sequence of SEQ ID NO: 250 shown in Table 4 above. This propeptide can be present, as shown in SEQ ID NO: 250 in Table 4 above, or can optionally be removed as shown in SEQ ID NO: 251 in Table 4 above.

The native amino acid sequence of the phospholipase of SEQ ID NO: 373 includes a propeptide (CCDEYLQTPAAPHDIDSKLPHKLS, SEQ ID NO: 388). This propeptide is underlined in the sequence of SEQ ID NO: 373 shown in Table 4 above. This propeptide can be present, as shown in SEQ ID NO: 373 in Table 4 above, or can optionally be removed as shown in SEQ ID NO: 374 in Table 4 above.

The native amino acid sequence of the phospholipase of SEQ ID NO: 253 includes the signal peptide MKGKLLKGVLSLGVGLGALYSGTSAQAE (SEQ ID NO: 318) at the amino-terminus of the sequence, immediately preceding the first amino acid of SEQ ID NO: 253. This signal peptide is not included in SEQ ID NO: 253. However, the signal peptide of SEQ ID NO: 318, or another signal peptide, can optionally be included at the amino terminus of the phospholipase of SEQ ID NO: 253, or at the amino-terminus of any of the other enzymes or expansin proteins described herein.

The native amino acid sequence of the phospholipase of SEQ ID NO: 254 includes the signal peptide MKKKVLALAAAITVVAPLQSVAFA (SEQ ID NO: 319) at the amino terminus of the sequence, immediately preceding the first amino acid of SEQ ID NO: 254. This signal peptide is not included in SEQ ID NO: 254. However, the signal peptide of SEQ ID NO: 319, or another signal peptide, can optionally be included at the amino terminus of the phospholipase of SEQ ID NO: 254, or at the amino terminus of any of the other enzymes or expansin proteins described herein.

The native amino acid sequence of the phospholipase of SEQ ID NO: 255 includes the signal peptide MKRKICKALICATLATSLWAGASTKVYAW (SEQ ID NO: 320) at the amino-terminus of the sequence, immediately preceding the first amino acid of SEQ ID NO: 255. This signal peptide is not included in SEQ ID NO: 255. However, the signal peptide of SEQ ID NO: 320, or another signal peptide, can optionally be included at the amino terminus of the phospholipase of SEQ ID NO: 255, or at the amino-terminus of any of the other enzymes or expansin proteins described herein.

The native amino acid sequence of the phospholipase of SEQ ID NO: 256 includes the signal peptide MLAGPLAAALPARA (SEQ ID NO: 321) at the amino-terminus of the sequence, immediately preceding the first amino acid of SEQ ID NO: 256. This signal peptide is not included in SEQ ID NO: 256. However, the signal peptide of SEQ ID NO: 321, or another signal peptide, can optionally be included at the amino terminus of the phospholipase of SEQ ID NO: 256, or at the amino-terminus of any of the other enzymes or expansin proteins described herein.

Alternatively, the signal peptide (SEQ ID NO: 322)
MTSRYRSSEAHQGLASFSPRRRTVVKAAAATAVLAGPLAAALPARA can optionally be added to SEQ ID NO: 256, at the amino-terminus of the sequence, immediately preceding the first amino acid of SEQ ID NO: 256. The signal peptide of SEQ ID NO: 322 can also optionally be included at the amino terminus of any of the other enzymes or expansin proteins described herein.

The native amino acid sequence of the phospholipase of SEQ ID NO: 257 includes the signal peptide MKKKVLALAAAITLVAPLQNVAFA (SEQ ID NO: 323) at the amino-terminus of the sequence, immediately preceding the first amino acid of SEQ ID NO: 257. This signal peptide is not included in SEQ ID NO: 257. However, the signal peptide of SEQ ID NO: 323, or another signal peptide, can optionally be included at the amino-terminus of the phospholipase of SEQ ID NO: 257, or at the amino-terminus of any of the other enzymes or expansin proteins described herein.

The native amino acid sequence of the phospholipase of SEQ ID NO: 373 includes the signal peptide MKFKNVVLGMCLTASVLVFPVTIKANA (SEQ ID NO: 376) at the amino-terminus of the sequence, immediately preceding the first amino acid of SEQ ID NO: 373. This signal peptide is not included in SEQ ID NO: 373. However the signal peptide of SEQ ID NO: 376, or another signal peptide, can optionally be included at the amino-terminus of the phospholipase of SEQ ID NO: 373, or at the amino-terminus of any of the other enzymes or expansin proteins described herein. Where the signal peptide of SEQ ID NO: 376 is included at the amino terminus of the phospholipase of SEQ ID NO: 373, this enzyme is referred to herein by ID Code D473.

The native amino acid sequence of the phospholipase of SEQ ID NO: 375 includes the signal peptide MSNKKLILKLFICSTIFITFVFALHDKQVVA (SEQ ID NO: 377) at the amino-terminus of the sequence, immediately preceding the first amino acid of SEQ ID NO: 375. This signal peptide is not included in SEQ ID NO: 375. However the signal peptide of SEQ ID NO: 377 or another signal peptide, can optionally be included at the amino terminus of the phospholipase of SEQ ID NO: 375, or at the amino terminus of any of the other enzymes or expansin proteins described herein. Where the signal peptide of SEQ ID NO: 377 is included at the amino terminus of the phospholipase of SEQ ID NO: 375, this enzyme is referred to herein by ID Code E258.

3. Lipases

Lipases are enzymes that exert their enzymatic activity on lipids, cleaving fatty acid chains off of larger lipid molecules such as triglycerides. Lipases are a class of enzymes which have the ability to act at the interface between aqueous and organic phases. Lipases primarily catalyze the hydrolysis of ester bonds in water-insoluble lipid substrates (e.g., longer acyl chain length derivatives).

Lipases can be used for any of the plant growth stimulating or plant health-promoting purposes described herein, but are particularly well-suited for stimulating plant growth and enhancing nutrient uptake. These effects in turn lead to increased crop yields, improved early season vigor, and decreased susceptibility of plants to early season stresses.

For ease of reference, illustrative lipase amino acid sequences are provided in Table 5 below, together with their SEQ ID NOs.

TABLE 5

Amino acid sequences for lipases

| Enzyme (SEQ ID NO) | SEQ ID NO. |
| --- | --- |
| Lipase 1 (4Q7_BG78_03400) *Bacillus thuringiensis* serovar israelensis 4Q7 | 262 |
| Lipase 2 (Bsub168 estA) *Bacillus subtilis* subsp. *subtilis* str. 168 | 263 |
| Lipase (*Burkholderia cepacia*) | 264 |
| Lipase (*Pseudomonas fluorescens*) | 265 |
| Lipase (*Burkholderia stearothermophilus*) | 266 |

The native amino acid sequence of the lipase of SEQ ID NO: 263 includes the signal peptide MKFVKRRI-IALVTILMLSVTSLFALQPSAKA (SEQ ID NO: 324) at the amino-terminus of the sequence, immediately preceding the first amino acid of SEQ ID NO: 263. This signal peptide is not included in SEQ ID NO: 263. However, the signal peptide of SEQ ID NO: 324, or another signal peptide, can optionally be included at the amino terminus of the lipase of SEQ ID NO: 263, or at the amino-terminus of any of the other enzymes or expansin proteins described herein.

The native amino acid sequence of the lipase of SEQ ID NO: 264 includes the signal peptide MARTMRSRVVAGA-VACAMSIAPFAGTTAVMTLATTHAAMAATAP (SEQ ID NO: 325) at the amino-terminus of the sequence, immediately preceding the first amino acid of SEQ ID NO: 264. This signal peptide is not included in SEQ ID NO: 264. However, the signal peptide of SEQ ID NO: 325, or another signal peptide, can optionally be included at the amino-terminus of the lipase of SEQ ID NO: 264, or at the amino-terminus of any of the other enzymes of expansin proteins described herein.

The native amino acid sequence of the lipase of SEQ ID NO: 265 includes the signal peptide MGIFDYKNLGTEG-SKTLFADAMA (SEQ ID NO: 326) at the amino-terminus of the sequence, immediately preceding the first amino acid of SEQ ID NO: 265. This signal peptide is not included in SEQ ID NO: 265. However, the signal peptide of SEQ ID NO: 326, or another signal peptide, can optionally be included at the amino-terminus of SEQ ID NO: 265, or at the amino terminus of any of the other enzymes or expansin proteins described herein.

4. Xylanases

Xylanases (EC 3.2.1.8) are a class of enzymes that act on the polysaccharide xylan, a common sugar found in plants and in the soil. Xylans consist of a β-1,4-linked xylose main chain in which individual xylose molecules often are decorated with methyl glucuronic acid and arabinose. Arabinoxylans are the primary hemicelluloses in mature monocot tissues. Xylanases catalyze the cleavage of internal β-1,4-bonds between two xylose molecules within polysaccharide main chains.

Xylanases can be used as a seed treatment, delivered to the plant growth medium (e.g., via in furrow application or as a soil amendment), or applied as a foliar treatment onto plants to generate smaller sugar chains that can be taken up by the plant or used to feed the surrounding microbiome.

For ease of reference, illustrative xylanase amino acid sequences are provided in Table 6 below, together with their SEQ ID NOs.

TABLE 6

Amino acid sequences for xylanases

| Enzyme | SEQ ID NO. |
| --- | --- |
| β-xylanase 3 (CsacDSM8903 2408) (*Caldicellulosiruptor saccharolyticus* DSM 8903) | 267 |
| β-xylanase 2 (Bsub168 xynA) (*Bacillus subtilis* subsp. *subtilis* str. 168) (ID CODE: E146) | 268 |
| β-xylanase 1 (Bsub168 xynD) (*Bacillus subtilis* subsp. *subtilis* str. 168) | 269 |
| β-xylanase 4 (Bstearo xynA) *Geobacillus stearothermophilus* (*Bacillus stearothermophilus*) | 270 |
| Xylanase (*Thermomyces lanuginosus*) | 271 |
| β-Xylanase (*Neocallimastix patriciarum*) | 272 |
| Xylanase (Xyn C) (*Bacillus subtilis* strain 168) (ID CODE: E232) | 273 |

The native amino acid sequence of the xylanase of SEQ ID NO: 267 includes the signal peptide MCEN-LEMLNLSLAKTYKDYFKIGAAVTA (SEQ ID NO: 327) at the amino-terminus of the sequence, immediately preceding the first amino acid of SEQ ID NO: 267. This signal peptide is not included in SEQ ID NO: 267. However, the signal peptide of SEQ ID NO: 327, or another signal peptide, can optionally be included at the amino terminus of the xylanase of SEQ ID NO: 267, or at the amino-terminus of any of the other enzymes or expansin proteins described herein.

The native amino acid sequence of the xylanase of SEQ ID NO: 268 includes the signal peptide MFKFKKNFLVGL-SAALMSISLFSATASA (SEQ ID NO: 328) at the amino-terminus of the sequence, immediately preceding the first amino acid of SEQ ID NO: 268. This signal peptide is not included in SEQ ID NO: 268. However, the signal peptide of SEQ ID NO: 238, or another signal peptide, can optionally be included at the amino terminus of the xylanase of SEQ ID NO: 268, or at the amino-terminus of any of the other enzymes or expansin proteins described herein. Where the xylanase of SEQ ID NO: 268 includes the signal peptide of SEQ ID NO: 328 at its amino terminus, this enzyme is referred to herein by ID Code E100.

The native amino acid sequence of the xylanase of SEQ ID NO: 269 includes the signal peptide MRKKCSVCLWIL-VLLLSCLSGKSAYA (SEQ ID NO: 329) at the amino-terminus of the sequence, immediately preceding the first amino acid of SEQ ID NO: 269. This signal peptide is not included in SEQ ID NO: 269. However, the signal peptide of SEQ ID NO: 329, or another signal peptide, can optionally be included at the amino terminus of the xylanase of SEQ ID NO: 269, or at the amino-terminus of any of the other enzymes or expansin proteins described herein.

The native amino acid sequence of the xylanase of SEQ ID NO: 270 includes the signal peptide MKLKKKMLTLLLTASMSFGLFGATSSA (SEQ ID NO: 330) at the amino-terminus of the sequence, immediately preceding the first amino acid of SEQ ID NO: 270. This signal peptide is not included in SEQ ID NO: 270. However, the signal peptide of SEQ ID NO: 330, or another signal peptide, can optionally be included at the amino terminus of the xylanase of SEQ ID NO: 270, or at the amino-terminus of any of the other enzymes or expansin proteins described herein.

The native amino acid sequence of the xylanase of SEQ ID NO: 273 includes the signal peptide MIPRIKKTICVLL-VCFTMLSVMLGPGATEVLA (SEQ ID NO: 331) at the amino-terminus of the sequence, immediately preceding the first amino acid of SEQ ID NO: 273. This signal peptide is not included in SEQ ID NO: 273. However, the signal peptide of SEQ ID NO: 331, or another signal peptide, can optionally be included at the amino terminus of the xylanase of SEQ ID NO: 273, or at the amino-terminus of any of the other enzymes or expansin proteins described herein.

5. Xylosidases

Xylosidases (EC 3.2.1.37) are a class of enzymes that cleave single xylose molecules off of shorter fragments of xylan, a common polysaccharide found in plants and in the soil. Xylans consist of a β-1,4-linked xylose main chain in which individual xylose molecules often are decorated with methyl glucuronic acid and arabinose. Arabinoxylans are the primary hemicelluloses in mature monocot tissues. Xylosidases catalyze the cleavage of terminal β-1,4-bonds in the xylose main chain of xylans.

Xylosidases can be used as a seed treatment, delivered to the plant growth medium (e.g., via in furrow application or as a soil amendment), or applied as a foliar treatment onto plants to generate smaller sugar chains that can be taken up by the plant or used to feed the surrounding microbiome.

For ease of reference, illustrative xylosidase amino acid sequences are provided in Table 7 below, together with their SEQ ID NOs.

TABLE 7

Amino acid sequences for xylosidases

| Enzyme | SEQ ID NO. |
|---|---|
| Xylosidase (CsacDSM8903 2404) (*Caldicellulosiruptor saccharolyticus* DSM 8903) | 274 |
| Xylosidase (B) (*Bacillus pumilus* strain IPO) (ID CODE: E194) | 275 |
| Xylosidase (B) (*Bacillus subtilis* strain 168) (ID CODE: E175) | 276 |

6. Lactonases

Lactonases can be used for any of the plant growth stimulating or plant health promoting purposes described herein, but are especially suitable for decreasing the susceptibility of plants to pathogens. Lactonases are also described as acyl-homoserine lactonases and are metalloenzymes produced by certain species of bacteria. For example, lactonases can be found in bacteria of the Phyla Bacteriodetes, Firmicutes, Actinobacteria, and in bacteria of the genera of *Pseudomonas* and *Bacillus*, as well as others. Lactonases target and inactivate acylated homoserine lactones. Lactonases hydrolyze the ester bonds of small hormone-like molecules commonly known as homoserine lactones. In the hydrolysis of these lactone bonds, lactonase acts to prevent these homoserine lactones from binding to their transcriptionally-regulated targets and thereby interfere with quorum sensing. However, lactonase secretion from naturally occurring bacteria that colonize soil or plants is limited and inducible, and thus it would be desirable to providing higher levels of lactonase to the environment of a plant.

Lactonases can be applied to plants (e.g., foliarly or as a seed treatment) or a plant growth medium in order to reduce the levels of lactones in the environment. Without being bound to any particular theory, it is believed that this reduction in the level of lactones can in turn lead to reduction in plant disease, as well as a secondary increase in plant growth and development.

For ease of reference, illustrative lactonase amino acid sequences are provided in Table 8 below, together with their SEQ ID NOs.

TABLE 8

Amino acid sequences for lactonases

| Enzyme (SEQ ID NO) | SEQ ID NO. |
|---|---|
| Lactonase (AiiA) (*Bacillus thuringiensis* Strain B184) (ID CODE: H51) | 277 |
| Lactonase (AiiA) (*Bacillus pseudomycoides* strain B30) | 278 |

7. Chitosanases

Chitosanases can be used for any of the plant growth stimulating or plant health promoting purposes described herein, but are especially suitable for increasing nutrient uptake and increasing plant growth. This in turn leads to increased crop yield, improved early season vigor, and decreased susceptibility to early season stresses. Chitosanases are also useful for protecting plants from pathogens.

For ease of reference, illustrative chitosanase amino acid sequences are provided in Table 9 below, together with their SEQ ID NOs.

TABLE 9

Amino acid sequences for chitosanases

| Enzyme (SEQ ID NO) | SEQ ID NO. |
|---|---|
| Chitosanase (Bsub168 csn) (*Bacillus subtilis* subsp. *subtilis* str. 168) | 279 |
| Chitosanase (*Streptomyces* species N174) | 280 |

The native amino acid sequence of the chitosanase of SEQ ID NO: 279 includes the signal peptide MKISMQKADFWKKAAISLLVFTMFFTLMMSETVFA (SEQ ID NO: 332) at the amino-terminus of the sequence, immediately preceding the first amino acid of SEQ ID NO: 279. This signal peptide is not included in SEQ ID NO: 279. However, the signal peptide of SEQ ID NO: 332, or another signal peptide, can optionally be included at the amino terminus of the chitosanase of SEQ ID NO: 279, or at the amino-terminus of any of the other enzymes or expansin proteins described herein.

The native amino acid sequence of the chitosanase of SEQ ID NO: 280 includes the signal peptide MHSQHR-TARIALAVVLTAIPASLATAGVGYASTQASTAVK (SEQ ID NO: 333) at the amino-terminus of the sequence, immediately preceding the first amino acid of SEQ ID NO: 280. This signal peptide is not included in SEQ ID NO: 280. However, the signal peptide of SEQ ID NO: 333, or another signal peptide, can optionally be included at the amino-terminus of the chitosanase of SEQ ID NO: 280, or at the amino terminus of any of the other enzymes or expansin proteins described herein.

8. Glucanases

Glucanases use water to break chemical bonds between individual glucose molecules in glucans, which are long chain polysaccharides. Glucans can be broken down into two types, alpha glucan, consisting of primarily alpha chains of glucose molecules, and beta glucans, consisting of primarily beta chains of glucose molecules. Common alpha glucans include dextrans, glycogens, pullalans, and starch. Alpha glucans generally include combinations of alpha 1,4; alpha 1,6, and/or alpha 1,3 glucans and branches. Glucanases that are specific for cleaving alpha linkages are called alpha-glucanases. Beta glucanases are specific to beta linkages between glucans. Common beta glucans include cellulose, laminarin, lichenin, zymosan. Beta glucans are commonly found with b1,3; b1,4, and/or b1,6 linkages between glucose molecules. Glucanases can be either "exo" or "endo" depending on the location of the cleavage of the polysaccharide. Alpha-, beta-, exo- and endo-glucanases are all effective for stimulating plant growth.

β-1,4-endoglucanases comprise a class of enzymes (EC 3.2.1.4) that function in the endohydrolysis of the (1→4)-β-D-glucosidic linkages in cellulose, lichenin and cereal β-D-glucans and therefore are effective for the breakdown of a variety of polysaccharides that are components of the plant cell wall.

Xyloglucanases (EC 3.2.1.151) comprise a class of enzymes that catalyze the cleavage of xyloglucan oligosaccharides. Xyloglucans consist of β-1,4-linked glucose main chain primarily decorated with α-1,6-linked xylose. Xyloglucans are the primary hemicelluloses in dicot plants. Xyloglucanases catalyze the endo-hydrolysis of the internal β-1,4 bonds in the glucose main chain of xyloglucans. This results in specific oligosaccharide mixtures arising from cleavage at specific sites, usually unbranched, glucosyl residues.

Lichenases (EC 3.2.1.73) are a class of enzymes also referred to as β-1,3-1,4-endoglucanase that specifically catalyze the cleavage of β-1,4 bonds preceded by a β-1,3 linkage in a glucan backbone. Mixed-linked glucans consist solely of glucose monomers, which are linked by β-1,4 and β-1,3 bonds. Mixed linked-glucans occur in monocot seeds and in the cell walls of developing monocot tissues such as corn and wheat.

Glucanases can be used for any of the plant growth stimulating or plant health promoting purposes described herein, but are particularly useful for increasing nutrient uptake and stimulating plant growth. This in turn leads to increased crop yield, improved early season vigor, and decreased susceptibility to early season stresses. Glucanases can also be used for protecting plants from pathogens and for reducing susceptibility to an environmental stress in a plant.

For ease of reference, illustrative glucanase amino acid sequences are provided in Table 10 below, together with their SEQ ID NOs.

TABLE 10

Amino acid sequences for glucanases

| Enzyme | SEQ ID NO. |
|---|---|
| Endo-1,4-β-D-glucanase (*Acidothermus cellulolyticus*) | 281 |
| Endoglucanase I (*Trichoderma reesei*) | 282 |
| Endoglucanase II (*Trichoderma reesei*) | 283 |
| Endoglucanase IV (*Trichoderma reesei*) | 284 |
| Endoglucanase V (*Trichoderma reesei*) | 285 |
| Endoglucanase VII (*Trichoderma reesei*) | 286 |
| beta-1,4-endoglucanase (*Trichoderma reesei*) | 287 |
| Cellobiohydrolase I (*Trichoderma reesei*) | 288 |
| Cellobiohydrolase II (*Trichoderma reesei*) | 289 |
| beta-Glucosidase I (*Trichoderma reesei*) | 290 |
| beta-Glucosidase II (*Trichoderma reesei*) | 291 |
| exo-1,3-β-D-Glucanase (*Aspergillus oryzae*) | 292 |
| Endoglucanase β-1,4 (*Bacillus subtilis* subsp. *subtilis* str. 168) (ID CODE: E112) | 293 |
| Endoglucanase B1,4 (*Bacillus subtilis* subsp. *subtilis* str. 168, without carbohydrate-binding domain) | 294 |
| Lichenase (Bsub 168 bglS) (*Bacillus subtilis* subsp. *subtilis* str. 168) | 295 |
| Lichenase (β-1,3-1,4-endoglucanase) licB (ID Code: D436) (*Clostridium thermocellum* ATCC 27405) | 296 |
| Beta-(1,3) endoglucanase (BglH) (*Bacillus circulans* strain IAM1165) | 297 |
| Beta-(1,3) glucosidase (GclA) (*Bacillus circulans* strain WL-12) | 298 |
| Xyloglucanase XG5 (catalytic domain) (*Paenibacillus pabuli*) (ID CODE: D381) | 299 |
| Xyloglucanase XG12 (catalytic domain) (*Bacillus licheniformis*) (ID CODE: E149) | 300 |
| β-1,3-D-glucanase (*Helix pomatia*) | 301 |
| Amylase (amyE) (*Bacillus subtilis* 168) | 302 |

The native amino acid sequence of the glucanase of SEQ ID NO: 293 includes the signal peptide MKRSISIFITCL-LITLLTMGGMIASPASA (SEQ ID NO: 334) at the amino-terminus of the sequence, immediately preceding the first amino acid of SEQ ID NO: 293. This signal peptide is not included in SEQ ID NO: 293. However, the signal peptide of SEQ ID NO: 334, or another signal peptide, can optionally be included at the amino terminus of the glucanase of SEQ ID NO: 293, or at the amino-terminus of any of the other enzymes or expansin proteins described herein. Where the signal peptide of SEQ ID NO: 334 is included at the amino terminus of SEQ ID NO: 293, this enzyme is referred to herein by ID Code E94.

The carbohydrate-binding domain can optionally be removed from the glucanase of SEQ ID NO: 293 by truncating the last 167 amino acids of the protein. SEQ ID NO: 294 provides the sequence for this glucanase wherein the carbohydrate-binding domain has been removed. The native signal peptide (SEQ ID NO: 334) is not included in SEQ ID NO: 294. However, the signal peptide of SEQ ID NO: 334, or another signal peptide, can optionally be included at the amino terminus of the glucanase of SEQ ID NO: 294. Where the signal peptide of SEQ ID NO: 334 is included at the amino terminus of SEQ ID NO: 294, this enzyme is referred to herein by ID Code EE113.

The native amino acid sequence of the glucanase of SEQ ID NO: 295 includes the signal peptide MPYLKRVLLLL-VTGLFMSLFAVTATASA (SEQ ID NO: 335) at the amino-terminus of the sequence, immediately preceding the first amino acid of SEQ ID NO: 295. This signal peptide is not included in SEQ ID NO: 295. However, the signal peptide of SEQ ID NO: 335, or another signal peptide, can optionally be included at the amino terminus of the glucanase of SEQ ID NO: 295, or at the amino-terminus of any of the other enzymes or expansin proteins described herein. Where the signal peptide of SEQ ID NO: 335 is included at the amino terminus of SEQ ID NO: 295, this enzyme is referred to herein by ID Code E111.

The native amino acid sequence of the glucanase of SEQ ID NO: 296 includes the signal peptide MKNRVISLL-MASLLLVLSVIVAPFYKA (SEQ ID NO: 336) at the amino-terminus of the sequence, immediately preceding the first amino acid of SEQ ID NO: 296. This signal peptide is not included in SEQ ID NO: 296. However, the signal peptide of SEQ ID NO: 336, or another signal peptide, can optionally be included at the amino terminus of the glucanase of SEQ ID NO: 296, or at the amino-terminus of any of the other enzymes or expansin proteins described herein.

The native amino acid sequence of the glucanase of SEQ ID NO: 297 includes the signal peptide MKRSQT-SEKRYRQRVLSLFLAVVMLASIGLLPTSKVQA (SEQ ID NO: 337) at the amino-terminus of the sequence, immediately preceding the first amino acid of SEQ ID NO: 297. This signal peptide is not included in SEQ ID NO: 297. However, the signal peptide of SEQ ID NO: 337, or another signal peptide, can optionally be included at the amino terminus of the glucanase of SEQ ID NO: 297, or at the amino-terminus of any of the other enzymes or expansin proteins described herein.

The native amino acid sequence of the glucanase of SEQ ID NO: 298 includes the signal peptide MKP-SHFTEKRFMKKVLGLFLVVVMLASVGVLPTSKVQA (SEQ ID NO: 338) at the amino-terminus of the sequence, immediately preceding the first amino acid of SEQ ID NO: 298. This signal peptide is not included in SEQ ID NO: 298. However, the signal peptide of SEQ ID NO: 338, or another signal peptide, can optionally be included at the amino terminus of the glucanase of SEQ ID NO: 298, or at the amino-terminus of any of the other enzymes or expansin proteins described herein.

The native amino acid sequence of the glucanase of SEQ ID NO: 299 includes the signal peptide MFKKWKKF-GISSLALVLVAAVAFTGWSAKASA (SEQ ID NO: 339) at the amino-terminus of the sequence, immediately preceding the first amino acid of SEQ ID NO: 299. This signal peptide is not included in SEQ ID NO: 299. However, the signal peptide of SEQ ID NO: 339, or another signal peptide, can optionally be included at the amino-terminus of the glucanase of SEQ ID NO: 299, or at the amino-terminus of any of the other enzymes or expansin proteins described herein.

The native amino acid sequence of the glucanase of SEQ ID NO: 300 includes the signal peptide MKNNHLLKSILL-WGAVCIIVLAGPLSAFA (SEQ ID NO: 340) at the amino-terminus of the sequence, immediately preceding the first amino acid of SEQ ID NO: 300. This signal peptide is not included in SEQ ID NO: 300. However, the signal peptide of SEQ ID NO: 340, or another signal peptide, can optionally be included at the amino-terminus of the glucanase of SEQ ID NO: 300, or at the amino-terminus of any of the other enzymes or expansin proteins described herein.

The native amino acid sequence of the glucanase of SEQ ID NO: 302 includes the signal peptide MFAKRFKT-SLLPLFAGFLLLFHLVLAGPAAASA (SEQ ID NO: 341) at the amino-terminus of the sequence, immediately preceding the first amino acid of SEQ ID NO: 302. This signal peptide is not included in SEQ ID NO: 302. However, the signal peptide of SEQ ID NO: 341, or another signal peptide, can optionally be included at the amino-terminus of the glucanase of SEQ ID NO: 302, or at the amino-terminus of any of the other enzymes or expansin proteins described herein.

9. Proteases

Proteases can be used for any of the plant growth stimulating or plant health promoting purposes described herein, but are particularly useful for increasing nutrient uptake and stimulating plant growth. This in turn leads to increased crop yield, improved early season vigor, and decreased susceptibility to early season stresses. Proteases are also useful for protecting plants from pathogens.

For ease of reference, illustrative protease amino acid sequences are provided in Table 11 below, together with their SEQ ID NOs.

TABLE 11

Amino acid sequences for proteases

| Enzyme | SEQ ID NO. |
|---|---|
| Protease 1 (Bsub168 aprX) (*Bacillus subtilis* subsp. *subtilis* str. 168) | 303 |
| Protease 2 (Bsub168 vpr) (*Bacillus subtilis* subsp. *subtilis* str. 168) | 304 |
| Protease 3 (*Engyodontium album* (*Tritirachium album*)) | 305 |
| Protease (aminopeptidase) (*Aspergillus saitoi*) | 306 |

The native amino acid sequence of the protease of SEQ ID NO: 304 includes the signal peptide MKKGIIRFLL-VSFVLFFALSTGITGVQA (SEQ ID NO: 342) at the amino-terminus of the sequence, immediately preceding the first amino acid of SEQ ID NO: 304. This signal peptide is not included in SEQ ID NO: 304. However, the signal peptide of SEQ ID NO: 342, or another signal peptide, can optionally be included at the amino terminus of the protease of SEQ ID NO: 304, or at the amino-terminus of any of the other enzymes or expansin proteins described herein.

The native amino acid sequence of the protease of SEQ ID NO: 306 includes the signal peptide MVVFSKTAALVLGL-STAVSA (SEQ ID NO: 343) at the amino-terminus of the sequence, immediately preceding the first amino acid of SEQ ID NO: 306. This signal peptide is not included in SEQ ID NO: 306. However, the signal peptide of SEQ ID NO: 343, or another signal peptide, can optionally be included at the amino-terminus of the protease of SEQ ID NO: 306, or at the amino-terminus of any of the other enzymes or expansin proteins described herein.

10. Mannanases

Mannanases (EC 3.2.1.78) are a class of enzymes that catalyze the cleavage of internal β-1,4-bonds between monosaccharide units in mannose/glucose main chain polysaccharides such as mannans. Mannans are minor constituents of cell walls in higher plants and consist of a β-1,4-linked mannose main chain, which may contain β-1,4-linked glucose monomers. Individual mannose monomers can further be decorated with galactose monomers. The small sugars that are released from polysaccharides through the action of mannanases can be taken up by plants as carbon sources and can also feed the inherent microbes that surround the plant.

For ease of reference, illustrative mannanase amino acid sequences are provided in Table 12 below, together with their SEQ ID NOs.

TABLE 12

Amino acid sequences for mannanases

| Enzyme | SEQ ID NO. |
| --- | --- |
| Mannanase (man5A) (*Bacillus circulans*) (ID CODE: E196) | 307 |
| Mannanase (gmuG) (*Bacillus subtilis* strain 168) (ID CODE: E177) | 308 |

The native amino acid sequence of the mannanase of SEQ ID NO: 307 includes the signal peptide MAKLQKGTILT-VIAALMFVILGSAAPKAAA (SEQ ID NO: 344) at the amino-terminus of the sequence, immediately preceding the first amino acid of SEQ ID NO: 307. This signal peptide is not included in SEQ ID NO: 307. However, the signal peptide of SEQ ID NO: 344, or another signal peptide, can optionally be included at the amino-terminus of the mannanase of SEQ ID NO: 307, or at the amino-terminus of any of the other enzymes or expansin proteins described herein.

The native amino acid sequence of the mannanase of SEQ ID NO: 308 includes the signal peptide MFKKHTISLLII-FLLASAVLAKPIEA (SEQ ID NO: 345) at the amino-terminus of the sequence, immediately preceding the first amino acid of SEQ ID NO: 308. This signal peptide is not included in SEQ ID NO: 308. However, the signal peptide of SEQ ID NO: 345, or another signal peptide, can optionally be included at the amino-terminus of the mannanase of SEQ ID NO: 308, or at the amino-terminus of any of the other enzymes or expansin proteins described herein.

11. Pectinases

Pectinases act on pectin and related polysaccharides to release small sugars. Specifically, pectin lyases (EC 4.2.2.10), also referred to as pectolyases, and endopolygalacturonases (EC 3.2.1.15) are both enzyme classes that catalyze the cleavage of internal β-1,4-bonds in galacturonan main chains. Galacturonans are found within the plant cell walls. However, they are primarily known as pectin, which is the main constituent of the middle lamella. Galacturonans mainly consist of α-1,4-linked galacturonic acid monomers, which can be esterified and extensively decorated. The small sugars that are released from polysaccharides through the action of pectinases can be taken up by a plant as a carbon source and can also feed the inherent microbes that surround the plant.

For ease of reference, illustrative pectinase amino acid sequences are provided in Table 13 below, together with their SEQ ID NOs.

TABLE 13

Amino acid sequence for pectinases

| Enzyme | SEQ ID NO. |
| --- | --- |
| Pectolyase (Endopolygalacturonase) (*Aspergillus niger* strain SC323) | 309 |
| Pectin lyase pelB (*Bacillus subtilis* strain 168) (ID CODE: E176) | 310 |

The native amino acid sequence of the pectolyase of SEQ ID NO: 309 includes the signal peptide MPSAKPLFCLAT-LAGAALA (SEQ ID NO: 346) at the amino-terminus of the sequence, immediately preceding the first amino acid of SEQ ID NO: 309. This signal peptide is not included in SEQ ID NO: 309. However, the signal peptide of SEQ ID NO: 346, or another signal peptide, can optionally be included at the amino-terminus of the pectolyase of SEQ ID NO: 309, or at the amino-terminus of any of the other enzymes or expansin proteins described herein. Where the pectolyase of SEQ ID NO: 309 includes the signal peptide of SEQ ID NO: 346 at its amino terminus, this enzyme is referred to herein by ID Code D405.

The native amino acid sequence of the pectolyase of SEQ ID NO: 310 includes the signal peptide MKRLCLWFTVFSLFLVLLPGKALG (SEQ ID NO: 347) at the amino-terminus of the sequence, immediately preceding the first amino acid of SEQ ID NO: 310. This signal peptide is not included in SEQ ID NO: 310. However, the signal peptide of SEQ ID NO: 347, or another signal peptide, can optionally be included at the amino-terminus of the pectolyase of SEQ ID NO: 310, or at the amino-terminus of any of the other enzymes or expansin proteins described herein.

12. Acid Phosphatases

Acid phosphatases act on insoluble and less soluble forms of phosphates in the soil, and release them from for uptake by plants. Acid phosphatase are a family of enzymes expressed widely across kingdoms. These enzymes non-specifically catalyze the hydrolysis of monoesters and anhydrides of phosphoric acid to produce inorganic phosphate and are distinct from other phosphatases due to their activity in acidic conditions. Plant acid phosphatases have been localized in the cytosol, vacuoles, and cell walls and are important for mobilizing organic phosphates in the soil. Acid phosphatases hydrolyze phytins, ATP, protein phosphates, nucleotide phosphates, and have a role in general metabolic reactions.

For ease of reference, descriptions of illustrative acid phosphatase amino acid sequences are provided in Table 14 below, together with their SEQ ID NOs.

TABLE 14

Amino acid sequences for acid phosphatases

| Enzyme | SEQ ID NO. |
| --- | --- |
| Acid phosphatase (*Triticum aestivum*) | 311 |
| Acid phosphatase (*Triticum aestivum*) | 312 |
| Acid Phosphatase (*Bacillus thuringiensis*) (ID CODE: E252) | 378 |

The native amino acid sequence of the acid phosphatase of SEQ ID NO: 311 includes the signal peptide MARGS-MAAVLAVLAVAALRCAPAAA (SEQ ID NO: 348) at the amino-terminus of the sequence, immediately preceding the first amino acid of SEQ ID NO: 311. This signal peptide is not included in SEQ ID NO: 311. However, the signal peptide of SEQ ID NO: 348, or another signal peptide, can optionally be included at the amino-terminus of the acid phosphatase of SEQ ID NO: 311, or at the amino-terminus of any of the other enzymes or expansin proteins described herein.

The native amino acid sequence of the acid phosphatase of SEQ ID NO: 312 includes the signal peptide MRGLGFAALSLHVLLCLANGVSSRRTSSYV (SEQ ID NO: 349) at the amino-terminus of the sequence, immediately preceding the first amino acid of SEQ ID NO: 312. This signal peptide is not included in SEQ ID NO: 312. However, the signal peptide of SEQ ID NO: 349, or another signal peptide, can optionally be included at the amino-terminus of the acid phosphatase of SEQ ID NO: 312, or at the amino-terminus of any of the other enzymes or expansin proteins described herein.

The native amino acid sequence of the acid phosphatase of SEQ ID NO: 378 includes the signal peptide MKMKR-GITTLLSVAVLSTSLVACSGTPEKTVA (SEQ ID NO: 379) at the amino-terminus of the sequence, immediately preceding the first amino acid of SEQ ID NO: 378. This signal peptide is not included in SEQ ID NO: 378. However, the signal peptide of SEQ ID NO: 379, or another signal peptide, can optionally be included at the amino terminus of the acid phosphatase of SEQ ID NO: 378, or at the amino-terminus of any of the other enzymes or expansin proteins described herein.

13. Phytases

Phytases act on phytic acids in soil, a source of free phosphate for plant growth. Phytases remove select phosphates off of the phytic acids, and the freed phosphates can be taken up by nearby plants.

For ease of reference, descriptions of illustrative phytase amino acid sequences are provided in Table 15 below, together with their SEQ ID NOs.

TABLE 15

Amino acid sequences for phytases

| Enzyme | SEQ ID NO. |
| --- | --- |
| Phytase (*Triticum aestivum*) | 313 |
| Phytase (*Triticum aestivum*) | 314 |
| Phytase (*Triticum aestivum*) | 315 |
| Phytase (*Bacillus subtilis* strain 168) (ID CODE: E246) | 380 |

The native amino acid sequence of the phytase of SEQ ID NO: 313 includes the signal peptide MWWGSLRLLLL-LAAAVAA (SEQ ID NO: 350) at the amino-terminus of the sequence, immediately preceding the first amino acid of SEQ ID NO: 313. This signal peptide is not included in SEQ ID NO: 313. However, the signal peptide of SEQ ID NO: 350, or another signal peptide, can optionally be included at the amino-terminus of the phytase of SEQ ID NO: 313, or at the amino-terminus of any of the other enzymes or expansin proteins described herein.

The native amino acid sequence of the phytase of SEQ ID NO: 314 includes the signal peptide MWWGSLRLLLL-LAAAVAA (SEQ ID NO: 350) at the amino-terminus of the sequence, immediately preceding the first amino acid of SEQ ID NO: 314. This signal peptide is not included in SEQ ID NO: 314. However, the signal peptide of SEQ ID NO: 350, or another signal peptide, can optionally be included at the amino-terminus of the phytase of SEQ ID NO: 314, or at the amino-terminus of any of the other enzymes or expansin proteins described herein.

The native amino acid sequence of the phytase of SEQ ID NO: 315 includes the signal peptide MGIWRGSLPLLL-LAA (SEQ ID NO: 351) at the amino-terminus of the sequence, immediately preceding the first amino acid of SEQ ID NO: 315. This signal peptide is not included in SEQ ID NO: 315. However, the signal peptide of SEQ ID NO: 351, or another signal peptide, can optionally be included at the amino-terminus of the phytase of SEQ ID NO: 315, or at the amino-terminus of any of the other enzymes or expansin proteins described herein.

The native amino acid sequence of the phytase of SEQ ID NO: 380 includes the signal peptide MKVPKTMLL-STAAGLLLSLTATSVSA (SEQ ID NO: 354) at the amino-terminus of the sequence, immediately preceding the first amino acid of SEQ ID NO: 380. This signal peptide is not included in SEQ ID NO: 380. However, the signal peptide of SEQ ID NO: 354, or another signal peptide can optionally be included at the amino-terminus of the phytase of SEQ ID NO: 380, or at the amino-terminus of any of the other enzymes or expansin proteins described herein.

14. Expansin Proteins

Expansin proteins aid plant walls in expanding during growth of the plant. Expansins are thus particularly useful in any of the methods for stimulating plant growth described herein.

For ease of reference, an illustrative expansin amino acid sequences is provided in Table 16 below, together with its SEQ ID NOs.

TABLE 16

Amino acid sequence for an expansin

| Expansin Protein | SEQ ID NO. |
| --- | --- |
| Expansin (Bsub168 exlX) (*Bacillus subtilis* subsp. *subtilis* str. 168) | 316 |

The native amino acid sequence of the expansin protein of SEQ ID NO: 316 includes the signal peptide MKKIM-SAFVGMVLLTIFCFSPQASA (SEQ ID NO: 352) at the amino terminus of the sequence, immediately preceding the first amino acid of SEQ ID NO: 316. This signal peptide is not included in SEQ ID NO: 316. However, the signal peptide of SEQ ID NO: 352, or another signal peptide, can optionally be included at the amino terminus of the protease of SEQ ID NO: 316, at the amino terminus of any of the enzymes described herein, or at the amino terminus of another expansin protein.

15. Signal Peptides

As described above, many of the native amino acid sequences of the enzymes and expansin proteins include signal peptides. When a fusion protein comprises an enzyme or expansin protein whose native sequence includes a signal peptide, the enzyme or expansin protein can be used without the signal peptide. Alternatively, the native signal peptide (or another signal peptide) can optionally be included at the amino terminus of the enzyme or expansin protein sequence, immediately preceding the first amino acid of the enzyme or expansin sequence.

In addition, a signal peptide can optionally be included at the amino terminus of the enzymes or expansin proteins whose native sequences do not include a signal peptide.

For ease of reference, amino acid sequences for illustrative signal peptides that can be added to any of the enzymes or expansin proteins described herein are provided below in Table 17. Any of the signal peptides listed in Table 17 below can be added at the amino terminus of any of the enzymes or expansin proteins described herein.

TABLE 17

Amino acid sequences for signal peptides

| Source Species for Signal Peptide | SEQ ID NO. |
| --- | --- |
| *Bacillus thuringiensis* | 317 |
| *Bacillus thuringiensis* serovar *israelensis* 4Q7 | 318 |
| *Bacillus cereus* ATCC 10987 | 319 |

TABLE 17-continued

Amino acid sequences for signal peptides

| Source Species for Signal Peptide | SEQ ID NO. |
|---|---|
| *Clostridium perfingens* | 320 |
| *Streptomyces chromofuscus* | 321 |
| *Streptomyces chromofuscus* | 322 |
| *Bacillus cereus* | 323 |
| *Bacillus subtilis* subsp. *subtilis* str. 168 | 324 |
| *Burkholderia cepacia* | 325 |
| *Pseudomonas fluorescens* | 326 |
| *Caldicellulosiruptor saccharolyticus* | 327 |
| *Bacillus subtilis* subsp. *subtilis* str. 168 | 328 |
| *Bacillus subtilis* subsp. *subtilis* str. 168 | 329 |
| *Geobacillus stearothermophilus* (*Bacillus stearothermophilus*) | 330 |
| *Bacillus subtilis* strain 168 | 331 |
| *Bacillus subtilis* subsp. *subtilis* str. 168 | 332 |
| *Streptomyces* species N174 | 333 |
| *Bacillus subtilis* subsp. *subtilis* str. 168 | 334 |
| *Bacillus subtilis* subsp. *subtilis* str. 168 | 335 |
| *Clostridium thermocellum* ATCC 27405 | 336 |
| *Bacillus circulans* | 337 |
| *Bacillus circulans* | 338 |
| *Paenibacillus pabuli* | 339 |
| *Bacillus licheniformis* | 340 |
| *Bacillus subtilis* 168 | 341 |
| *Bacillus subtilis* subsp. *subtilis* str. 168 | 342 |
| *Aspergillus saitoi* | 343 |
| *Bacillus circulans* | 344 |
| *Bacillus subtilis* strain 168 | 345 |
| *Aspergillus niger* | 346 |
| *Bacillus subtilis* strain 168 | 347 |
| *Triticum aestivum* | 348 |
| *Triticum aestivum* | 349 |
| *Triticum aestivum* | 350 |
| *Triticum aestivum* | 351 |
| *Bacillus subtilis* subsp. *subtilis* str. 168 | 352 |
| *Bacillus subtilis* subsp. *subtilis* str. 168 | 353 |
| *Bacillus subtilis* subsp. *subtilis* str. 168 | 354 |
| *Bacillus subtilis* subsp. *subtilis* str. 168 | 355 |
| *Bacillus thuringiensis* | 356 |
| *Bacillus thuringiensis* | 357 |
| *Bacillus thuringiensis* | 358 |
| *Bacillus pseudomycoides* | 359 |
| *Bacillus thuringiensis* serovar *israelensis* 4Q7 | 360 |
| *Listeria monocytogenes* | 376 |
| *Bacillus thuringiensis* | 377 |
| *Bacillus thuringiensis* | 379 |

C. Fusion Proteins for Expression in Recombinant *Bacillus cereus* Family Members Fusion proteins comprising a targeting sequence, exosporium protein, or exosporium protein fragment that targets the fusion protein to the exosporium of a recombinant *Bacillus cereus* family member are provided. The fusion proteins further comprise an enzyme having ACC deaminase activity, a phospholipase, a lipase, a xylanase, a xylosidase, a lactonase, a chitosanase, a protease, a glucanase, a phytase, an acid phosphatase, a pectinase, a mannanase, and/or an expansin protein.

In any of the fusion proteins described herein, the fusion protein can comprise: (1) a targeting sequence comprising an amino acid sequence having at least about 43% identity with amino acids 20-35 of SEQ ID NO: 1, wherein the identity with amino acids 25-35 is at least about 54%; (2) a targeting sequence comprising amino acids 1-35 of SEQ ID NO: 1; (3) a targeting sequence comprising amino acids 20-35 of SEQ ID NO: 1; (4) a targeting sequence comprising SEQ ID NO: 1; (5) an exosporium protein comprising an amino acid sequence having at least 85% identity with SEQ ID NO: 2; (6) a targeting sequence comprising amino acids 2-35 of SEQ ID NO: 1; (7) a targeting sequence comprising amino acids 5-35 of SEQ ID NO: 1; (8) a targeting sequence comprising amino acids 8-35 of SEQ ID NO: 1; (9) a targeting sequence comprising amino acids 10-35 of SEQ ID NO: 1; (10) a targeting sequence comprising amino acids 15-35 of SEQ ID NO: 1; (11) a targeting sequence comprising amino acids 1-27 of SEQ ID NO: 3; (12) a targeting sequence comprising amino acids 12-27 of SEQ ID NO: 3; (13) a targeting sequence comprising SEQ ID NO: 3; (14) an exosporium protein comprising an amino acid sequence having at least 85% identity with SEQ ID NO: 4; (15) a targeting sequence comprising amino acids 2-27 of SEQ ID NO: 3; (16) a targeting sequence comprising amino acids 5-27 of SEQ ID NO: 3; (17) a targeting sequence comprising amino acids 8-27 of SEQ ID NO: 3; (18) a targeting sequence comprising amino acids 10-27 of SEQ ID NO: 3; (19) a targeting sequence comprising amino acids 1-38 of SEQ ID NO: 5; (20) a targeting sequence comprising amino acids 23-38 of SEQ ID NO: 5; (21) a targeting sequence comprising SEQ ID NO: 5; (22) an exosporium protein comprising an amino acid sequence having at least 85% identity with SEQ ID NO: 6; (23) a targeting sequence comprising amino acids 2-38 of SEQ ID NO: 5; (24) a targeting sequence comprising amino acids 5-38 of SEQ ID NO: 5; (25) a targeting sequence comprising amino acids 8-38 of SEQ ID NO: 5; (26) a targeting sequence comprising amino acids 10-38 of SEQ ID NO: 5; (27) a targeting sequence comprising amino acids 15-38 of SEQ ID NO: 5; (28) a targeting sequence comprising amino acids 20-38 of SEQ ID NO: 5; (29) a targeting sequence comprising amino acids 1-28 of SEQ ID NO: 7; (30) a targeting sequence comprising amino acids 13-28 of SEQ ID NO: 7; (31) a targeting sequence comprising SEQ ID NO: 7; (32) an exosporium protein comprising an amino acid sequence having at least 85% identity with SEQ ID NO: 8; (33) a targeting sequence comprising amino acids 2-28 of SEQ ID NO: 7; (34) a targeting sequence comprising amino acids 5-28 of SEQ ID NO: 7; (35) a targeting sequence comprising amino acids 8-28 of SEQ ID NO: 7; (36) a targeting sequence comprising amino acids 10-28 of SEQ ID NO: 7; (37) a targeting sequence comprising amino acids 1-24 of SEQ ID NO: 9; (38) a targeting sequence comprising amino acids 9-24 of SEQ ID NO: 9; (39) a targeting sequence comprising SEQ ID NO: 9; (40) an exosporium protein comprising an amino acid sequence having at least 85% identity with SEQ ID NO: 10; (41) a targeting sequence comprising amino acids 2-24 of SEQ ID NO: 9; (42) a targeting sequence comprising amino acids 5-24 of SEQ ID NO: 9; (43) a targeting sequence comprising amino acids 8-24 of SEQ ID NO: 9; (44) a targeting sequence comprising amino acids 1-33 of SEQ ID NO:11; (45) a targeting sequence comprising amino acids 18-33 of SEQ ID NO: 11; (46) a targeting sequence comprising SEQ ID NO: 11; (47) an exosporium protein comprising an amino acid sequence having at least 85% identity with SEQ ID NO: 12; (48) a targeting sequence comprising amino acids 2-33 of SEQ ID NO: 11; (49) a targeting sequence comprising amino acids 5-33 of SEQ ID NO: 11; (50) a targeting sequence comprising amino acids 8-33 of SEQ ID NO: 11; (51) a targeting sequence comprising amino acids 10-33 of SEQ ID NO: 11; (52) a targeting sequence comprising amino acids 15-33 of SEQ ID NO: 11; (53) a targeting sequence comprising amino acids 1-33 of SEQ ID NO: 13; (54) a targeting sequence comprising amino acids 18-33 of SEQ ID NO: 13; (55) a targeting sequence comprising SEQ ID NO:13; (56) an exosporium protein comprising an amino acid sequence having at least 85% identity with SEQ ID NO:14; (57) a targeting sequence comprising amino acids 2-33 of SEQ ID NO: 13; (58) a targeting sequence comprising amino acids 5-33 of SEQ ID NO: 13; (59) a targeting sequence comprising amino acids 8-33 of SEQ ID NO: 13; (60) a targeting sequence comprising amino acids 10-33 of SEQ ID NO: 13; (61) a targeting sequence comprising amino acids 15-33 of SEQ ID NO: 13; (62) a targeting sequence comprising amino acids 1-43 of SEQ ID NO: 15; (63) a targeting sequence comprising amino acids 28-43 of SEQ ID NO: 15; (64) a targeting sequence comprising SEQ ID NO:15; (65) an exosporium protein comprising an amino acid sequence having at least 85% identity with SEQ ID NO:16; (66) a targeting sequence comprising amino acids 2-43 of SEQ ID NO: 15; (67) a targeting sequence comprising amino acids 5-43 of SEQ ID NO: 15; (68) a targeting sequence comprising amino acids 8-43 of SEQ ID NO: 15; (69) a targeting sequence comprising amino acids 10-43 of SEQ ID NO: 15; (70) a targeting sequence comprising amino acids 15-43 of SEQ ID NO: 15; (71) a targeting sequence comprising amino acids 20-43 of SEQ ID NO: 15; (72) a targeting sequence comprising amino acids 25-43 of SEQ ID NO: 15; (73) a targeting sequence comprising amino acids 1-27 of SEQ ID NO: 17; (74) a targeting sequence comprising amino acids 12-27 of SEQ ID NO: 17; (75) a targeting sequence comprising SEQ ID NO:17; (76) an exosporium protein comprising an amino acid sequence having at least 85% identity with SEQ ID NO:18; (77) a targeting sequence comprising amino acids 2-27 of SEQ ID NO: 17; (78) a targeting sequence comprising amino acids 5-27 of SEQ ID NO: 17; (79) a targeting sequence comprising amino acids 8-27 of SEQ ID NO: 17; (80) a targeting sequence comprising amino acids 10-27 of SEQ ID NO: 17; (81) a targeting sequence comprising amino acids 1-33 of SEQ ID NO: 19; (82) a targeting sequence comprising amino acids 18-33 of SEQ ID NO: 19; (83) a targeting sequence comprising SEQ ID NO:19; (84) an exosporium protein comprising an amino acid sequence having at least 85% identity with SEQ ID NO:20; (85) a targeting sequence comprising amino acids 2-33 of SEQ ID NO: 19; (86) a targeting sequence comprising amino acids 5-33 of SEQ ID NO: 19; (87) a targeting sequence comprising amino acids 8-33 of SEQ ID NO: 19; (88) a targeting sequence comprising amino acids 10-33 of SEQ ID NO: 19; (89) a targeting sequence comprising amino acids 15-33 of SEQ ID NO: 19; (90) a targeting sequence comprising amino acids 1-33 of SEQ ID NO: 21; (91) a targeting sequence comprising amino acids 18-33 of SEQ ID NO: 21; (92) a targeting sequence comprising SEQ ID NO:21; (93) an exosporium protein comprising an amino acid sequence having at least 85% identity with SEQ ID NO:22; (94) a targeting sequence comprising amino acids 2-33 of SEQ ID NO: 21; (95) a targeting sequence comprising amino acids 5-33 of SEQ ID NO: 21; (96) a targeting sequence comprising amino acids 8-33 of SEQ ID NO: 21; (97) a targeting sequence comprising amino acids 10-33 of SEQ ID NO: 21; (98) a targeting sequence comprising amino acids 15-33 of SEQ ID NO: 21; (99) a targeting sequence comprising amino acids 1-24 of SEQ ID NO: 23; (100) a targeting sequence comprising amino acids 9-24 of SEQ ID NO: 23; (101) a targeting sequence comprising SEQ ID NO:23; (102) an exosporium protein comprising an amino acid sequence having at least 85% identity with SEQ ID NO:24; (103) a targeting sequence comprising amino acids 2-24 of SEQ ID NO:23; (104) a targeting sequence comprising amino acids 5-24 of SEQ ID NO: 23; (105) a targeting sequence comprising amino acids 8-24 of SEQ ID NO: 23; (106) a targeting sequence comprising amino acids 1-24 of SEQ ID NO: 25; (107) a targeting sequence comprising amino acids 9-24 of SEQ ID NO: 25; (108) a targeting sequence comprising SEQ ID NO:25; (109) an exosporium protein comprising an amino acid sequence having at least 85% identity with SEQ ID NO:26; (110) a targeting sequence comprising amino acids 2-24 of SEQ ID NO: 25; (111) a targeting sequence comprising amino acids 5-24 of SEQ ID NO: 25; (112) a targeting sequence comprising amino acids 8-24 of SEQ ID NO: 25; (113) a targeting sequence comprising amino acids 1-30 of SEQ ID NO: 27; (114) a targeting sequence comprising amino acids 15-30 of SEQ ID NO: 27; (115) a targeting sequence comprising SEQ ID NO:27; (116) an exosporium protein comprising an amino acid sequence having at least 85% identity with SEQ ID NO:28; (117) a targeting sequence comprising amino acids 2-30 of SEQ ID NO: 27; (118) a targeting sequence comprising amino acids 5-30 of SEQ ID NO: 27; (119) a targeting sequence comprising amino acids 8-30 of SEQ ID NO: 27; (120) a targeting sequence comprising amino acids 10-30 of SEQ ID NO: 27; (121) a targeting sequence comprising amino acids 1-33 of SEQ ID NO: 29; (122) a targeting sequence comprising amino acids 18-33 of SEQ ID NO: 29; (123) a targeting sequence comprising SEQ ID NO:29; (124) an exosporium protein comprising an amino acid sequence having at least 85% identity with SEQ ID NO:30; (125) a targeting sequence comprising amino acids 2-33 of SEQ ID NO: 29; (126) a targeting sequence comprising amino acids 5-33 of SEQ ID NO: 29; (127) a targeting sequence comprising amino acids 8-33 of SEQ ID NO: 29; (128) a targeting sequence comprising amino acids 10-33 of SEQ ID NO: 29; (129) a targeting sequence comprising amino acids 15-33 of SEQ ID NO: 29; (130) a targeting sequence comprising amino acids 1-24 of SEQ ID NO: 31; (131) a targeting sequence comprising amino acids 9-24 of SEQ ID NO: 31; (132) a targeting sequence comprising SEQ ID NO:31; (133) an exosporium protein comprising an amino acid sequence having at least 85% identity with SEQ ID NO:32; (134) a targeting sequence comprising amino acids 2-24 of SEQ ID NO: 31; (135) a targeting sequence comprising amino acids 5-24 of SEQ ID NO: 31; (136) a targeting sequence comprising amino acids 8-24 of SEQ ID NO: 31; (137) a targeting sequence comprising amino acids 1-15 of SEQ ID NO: 33; (138) a targeting sequence comprising SEQ ID NO:33; (139) an exosporium protein comprising an amino acid sequence having at least 85% identity with SEQ ID NO:34; (140) a targeting sequence comprising amino acids 1-16 of SEQ ID NO: 35; (141) a targeting sequence comprising SEQ ID NO:35; (142) an exosporium protein comprising an amino acid sequence having at least 85% identity with SEQ ID NO:36; (143) a targeting sequence comprising amino acids 1-29 of SEQ ID NO:43; (144) a targeting sequence comprising amino acids 14-29 of SEQ ID NO: 43; (145) a targeting sequence comprising SEQ ID NO: 43; (146) an exosporium protein comprising an amino acid sequence having at least 85% identity with SEQ ID NO: 44; (147) a targeting sequence comprising amino acids 2-29 of SEQ ID NO: 43; (148) a targeting sequence comprising amino acids 5-29 of SEQ ID NO: 43; (149) a targeting sequence comprising amino acids 8-29 of SEQ ID NO: 43; (150) a targeting sequence comprising amino acids 10-29 of SEQ ID NO: 43; (151) a targeting sequence comprising amino acids 1-35 of SEQ ID NO: 45; (152) a targeting sequence comprising amino acids 20-35 of SEQ ID NO: 45; (153) a targeting sequence comprising SEQ ID NO: 45; (154) an exosporium protein comprising an amino acid sequence having at least 85% identity with SEQ ID NO: 46; (155) a targeting sequence comprising amino acids 2-35 of SEQ ID NO: 45; (156) a targeting sequence comprising amino acids 5-35 of SEQ ID NO: 45; (157) a targeting sequence comprising amino acids 8-35 of SEQ ID NO: 45; (158) a targeting sequence comprising amino acids 10-35 of SEQ ID NO: 45; (159) a targeting sequence comprising amino acids 15-35 of SEQ ID NO: 45; (160) a targeting sequence comprising amino acids 1-43 of SEQ ID NO: 47; (161) a targeting sequence comprising amino acids 28-43 of SEQ ID NO: 47; (162) a targeting sequence comprising SEQ ID NO: 47; (163) an exosporium protein comprising an amino acid sequence having at least 85% identity with SEQ ID NO: 48; (164) a targeting sequence comprising amino acids 2-43 of SEQ ID NO: 47; (165) a targeting sequence comprising amino acids 5-43 of SEQ ID NO: 47; (166) a targeting sequence comprising amino acids 8-43 of SEQ ID NO: 47; (167) a targeting sequence comprising amino acids 10-43 of SEQ ID NO: 47; (168) a targeting sequence comprising amino acids 15-43 of SEQ ID NO: 47; (169) a targeting sequence comprising amino acids 20-43 of SEQ ID NO: 47; (170) a targeting sequence comprising amino acids 25-43 of SEQ ID NO: 47; (171) a targeting sequence comprising amino acids 1-32 of SEQ ID NO: 49; (172) a targeting sequence comprising amino acids 17-32 of SEQ ID NO: 49; (173) a targeting sequence comprising SEQ ID NO: 49; (174) an exosporium protein comprising an amino acid sequence having at least 85% identity with SEQ ID NO: 50; (175) a targeting sequence comprising amino acids 2-32 of SEQ ID NO: 49; (176) a targeting sequence comprising amino acids 5-32 of SEQ ID NO: 49; (177) a targeting sequence comprising amino acids 8-32 of SEQ ID NO: 49; (178) a targeting sequence comprising amino acids 10-32 of SEQ ID NO: 49; (179) a targeting sequence comprising amino acids 15-32 of SEQ ID NO: 49; (180) a targeting sequence comprising amino acids 1-33 of SEQ ID NO: 51; (181) a targeting sequence comprising amino acids 18-33 of SEQ ID NO: 51; (182) a targeting sequence comprising SEQ ID NO: 51; (183) an exosporium protein comprising an amino acid sequence having at least 85% identity with SEQ ID NO: 52; (184) a targeting sequence comprising amino acids 2-33 of SEQ ID NO: 51; (185) a targeting sequence comprising amino acids 5-33 of SEQ ID NO: 51; (186) a targeting sequence comprising amino acids 8-33 of SEQ ID NO: 51; (187) a targeting sequence comprising amino acids 10-33 of SEQ ID NO: 51; (188) a targeting sequence comprising amino acids 15-33 of SEQ ID NO: 51; (189) a targeting sequence comprising amino acids 1-33 of SEQ ID NO: 53; (190) a targeting sequence comprising amino acids 18-33 of SEQ ID NO: 53; (191) a targeting sequence comprising SEQ ID NO: 53; (192) an exosporium protein comprising an amino acid sequence having at least 85% identity with SEQ ID NO: 54; (193) a targeting sequence comprising amino acids 2-33 of SEQ ID NO: 53; (194) a targeting sequence comprising amino acids 5-33 of SEQ ID NO: 53; (195) a targeting sequence comprising amino acids 8-33 of SEQ ID NO: 53; (196) a targeting sequence comprising amino acids 10-33 of SEQ ID NO: 53; (197) a targeting sequence comprising amino acids 15-33 of SEQ ID NO: 53; (198) a targeting sequence comprising amino acids 1-30 of SEQ ID NO: 55; (199) a targeting sequence comprising amino acids 15-30 of SEQ ID NO: 55; (200) a targeting sequence comprising SEQ ID NO: 55; (201) an exosporium protein comprising an amino acid sequence having at least 85% identity with SEQ ID NO: 56; (202) a targeting sequence comprising amino acids 2-30 of SEQ ID NO: 55; (203) a targeting sequence comprising amino acids 5-30 of SEQ ID NO: 55; (204) a targeting sequence comprising amino acids 8-30 of SEQ ID NO: 55; (205) a targeting sequence comprising amino acids 10-30 of SEQ ID NO: 55; (206) a targeting sequence comprising amino acids 1-130 of SEQ ID NO: 57; (207) a targeting sequence comprising amino acids 115-130 of SEQ ID NO: 57; (208) a targeting sequence comprising SEQ ID NO: 57; (209) an exosporium protein comprising an amino acid sequence having at least 85% identity with SEQ ID NO: 58; (210) a targeting sequence comprising amino acids 2-130 of SEQ ID NO: 57; (211) a targeting sequence comprising amino acids 5-130 of SEQ ID NO: 57; (212) a targeting sequence comprising amino acids 10-130 of SEQ ID NO: 57; (213) a targeting sequence comprising amino acids 20-130 of SEQ ID NO: 57; (214) a targeting sequence comprising amino acids 30-130 of SEQ ID NO: 57; (215) a targeting sequence comprising amino acids 40-130 of SEQ ID NO: 57; (216) a targeting sequence comprising amino acids 50-130 of SEQ ID NO: 57; (217) a targeting sequence comprising amino acids 60-130 of SEQ ID NO: 57; (218) a targeting sequence comprising amino acids 70-130 of SEQ ID NO: 57; (219) a targeting sequence comprising amino acids 80-130 of SEQ ID NO: 57; (220) a targeting sequence comprising amino acids 90-130 of SEQ ID NO: 57; (221) a targeting sequence comprising amino acids 100-130 of SEQ ID NO: 57; (222) a targeting sequence comprising amino acids 110-130 of SEQ ID NO: 57; (223) an exosporium protein fragment comprising an amino acid sequence having at least 85% identity with SEQ ID NO: 95; (224) a targeting sequence comprising SEQ ID NO: 96; (225) a targeting sequence comprising SEQ ID NO: 97; (226) a targeting sequence comprising SEQ ID NO: 98; (227) a targeting sequence comprising SEQ ID NO: 99; (228) a targeting sequence comprising SEQ ID NO: 100; (229) a targeting sequence comprising SEQ ID NO: 101; (230) a targeting sequence comprising SEQ ID NO: 102; (231) a targeting sequence comprising SEQ ID NO: 103; (232) a targeting sequence comprising SEQ ID NO: 104; (233) a targeting sequence comprising SEQ ID NO: 105; (234) a targeting sequence comprising SEQ ID NO: 106; (235) an exosporium protein comprising an amino acid sequence having at least 85% identity with SEQ ID NO: 108; (236) an exosporium protein comprising an amino acid sequence having at least 85% identity with SEQ ID NO: 109; (237) an exosporium protein comprising an amino acid sequence having at least 85% identity with SEQ ID NO: 110; (238) an exosporium protein comprising an amino acid sequence having at least 85% identity with SEQ ID NO: 111; (239) an exosporium protein comprising an amino acid sequence having at least 85% identity with SEQ ID NO: 112; (240) an exosporium protein comprising an amino acid sequence having at least 85% identity with SEQ ID NO: 113; (241) an exosporium protein comprising an amino acid sequence having at least 85% identity with SEQ ID NO: 114; (242) an exosporium protein comprising an amino acid sequence having at least 85% identity with SEQ ID NO: 115; (243) an exosporium protein comprising an amino acid sequence having at least 85% identity with SEQ ID NO: 116; (244) an exosporium protein comprising an amino acid sequence having at least 85% identity with SEQ ID NO: 117; (245) an exosporium protein comprising an amino acid sequence having at least 85% identity with SEQ ID NO: 118; (246) an exosporium protein comprising an amino acid sequence having at least 85% identity with SEQ ID NO: 119; (247) an exosporium protein comprising an amino acid sequence having at least 85% identity with SEQ ID NO: 120; (248) an exosporium protein comprising an amino acid sequence having at least 85% identity with SEQ ID NO: 121; (249) a targeting sequence comprising amino acids 22-31 of SEQ ID NO: 1; (250) a targeting sequence comprising amino acids 22-33 of SEQ ID NO: 1; (251) a targeting sequence comprising amino acids 20-31 of SEQ ID NO: 1; (252) a targeting sequence comprising amino acids 14-23 of SEQ ID NO: 3; (253) a targeting sequence comprising amino acids 14-25 of SEQ ID NO: 3; (254) a targeting sequence comprising amino acids 12-23 of SEQ ID NO: 3; (255) a targeting sequence comprising amino acids 1-30 of SEQ ID NO: 59; (256) a targeting sequence comprising SEQ ID NO: 59; (257) an exosporium protein comprising an amino acid sequence having at least 85% identity with SEQ ID NO: 60; (258) a targeting sequence comprising amino acids 2-30 of SEQ ID NO: 59; (259) a targeting sequence comprising amino acids 4-30 of SEQ ID NO: 59; (260) a targeting sequence comprising amino acids 6-30 of SEQ ID NO: 59; (261) a targeting sequence comprising amino acids 1-33 of SEQ ID NO: 61; (262) a targeting sequence comprising amino acids 18-33 of SEQ ID NO: 61; (263) a targeting sequence comprising SEQ ID NO: 61; (264) an exosporium protein comprising an amino acid sequence having at least 85% sequence identity with SEQ ID NO: 62; (265) a targeting sequence comprising amino acids 2-33 of SEQ ID NO: 61; (266) a targeting sequence comprising amino acids 5-33 of SEQ ID NO: 61; (267) a targeting sequence comprising amino acids 10-33 of SEQ ID NO: 61; (268) a targeting sequence comprising amino acids 15-33 of SEQ ID NO: 61; (269) a targeting sequence comprising amino acids 1-35 of SEQ ID NO: 63; (270) a targeting sequence comprising SEQ ID NO: 63; (271) an exosporium protein comprising an amino acid sequence having at least 85% identity with SEQ ID NO: 64; (272) a targeting sequence comprising amino acids 2-35 of SEQ ID NO: 63; (273) a targeting sequence comprising amino acids 5-35 of SEQ ID NO: 63; (274) a targeting sequence comprising amino acids 8-35 of SEQ ID NO: 63; (275) a targeting sequence comprising amino acids 10-35 of SEQ ID NO: 63; (276) a targeting sequence comprising amino acids 15-35 of SEQ ID NO: 63; (277) a targeting sequence comprising amino acids 1-24 of SEQ ID NO: 65; (278) a targeting sequence comprising amino acids 9-24 of SEQ ID NO: 65; (279) a targeting sequence comprising SEQ ID NO: 65; (280) an exosporium protein comprising an amino acid sequence having at least 85% identity with SEQ ID NO: 66; (281) a targeting sequence comprising SEQ ID NO: 107; (282) a targeting sequence comprising amino acids 2-24 of SEQ ID NO: 65; (283) a targeting sequence comprising amino acids 5-24 of SEQ ID NO: 65; (284) a targeting sequence comprising amino acids 1-27 of SEQ ID NO: 67; (285) a targeting sequence comprising amino acids 12-27 of SEQ ID NO: 67; (286) a targeting sequence comprising SEQ ID NO: 67; (287) an exosporium protein comprising an amino acid sequence having at least 85% identity with SEQ ID NO: 68; (288) an targeting sequence comprising amino acids 2-27 of SEQ ID NO: 67; (289) a targeting sequence comprising amino acids 5-27 of SEQ ID NO: 67; (290) a targeting sequence comprising amino acids 10-27 of SEQ ID NO: 67; (291) a targeting sequence comprising amino acids 1-38 of SEQ ID NO: 69; (292) a targeting sequence comprising amino acids 23-38 of SEQ ID NO: 69; (293) a targeting sequence comprising SEQ ID NO: 69; (294) an exosporium protein comprising an amino acid sequence having at least 85% identity with SEQ ID NO: 70; (295) a targeting sequence comprising amino acids 2-38 of SEQ ID NO: 69; (296) a targeting sequence comprising amino acids 5-38 of SEQ ID NO: 69; (297) a targeting sequence comprising amino acids 10-38 of SEQ ID NO: 69; (298) a targeting sequence comprising amino acids 15-38 of SEQ ID NO: 69; (299) an exosporium protein comprising SEQ ID NO: 72; (300) a targeting sequence comprising SEQ ID NO: 73; (301) an exosporium protein comprising an amino acid sequence having at least 95% identity with SEQ ID NO: 74; (302) a targeting sequence comprising amino acids 1-42 of SEQ ID NO: 75; (303) a targeting sequence comprising amino acids 27-42 of SEQ ID NO: 75; (304) a targeting sequence comprising SEQ ID NO: 75; (305) an exosporium protein comprising an amino acid sequence having at least 85% identity with SEQ ID NO: 76; (306) a targeting sequence comprising amino acids 2-42 of SEQ ID NO: 75; (307) a targeting sequence comprising amino acids 5-42 of SEQ ID NO: 75; (308) a targeting sequence comprising amino acids 10-42 of SEQ ID NO: 75; (309) a targeting sequence comprising amino acids 15-42 of SEQ ID NO: 75; (310) a targeting sequence comprising amino acids 20-42 of SEQ ID NO: 75; (311) a targeting sequence comprising amino acids 25-42 of SEQ ID NO: 75; (312) a targeting sequence comprising amino acids 1-24 of SEQ ID NO: 77; (313) a targeting sequence comprising amino acids 9-24 of SEQ ID NO: 77; (314) a targeting sequence comprising SEQ ID NO: 77; (315) an exosporium protein comprising an amino acid sequence having at least 85% identity with SEQ ID NO: 78; (316) a targeting sequence comprising amino acids 2-24 of SEQ ID NO: 77; (317) a targeting sequence comprising amino acids 5-24 of SEQ ID NO: 77; (318) an exosporium protein comprising an amino acid sequence having at least 85% identity with SEQ ID NO: 80; (319) a targeting sequence comprising amino acids 1-38 of SEQ ID NO: 81; (320) a targeting sequence comprising amino acids 23-38 of SEQ ID NO: 81; (321) a targeting sequence comprising SEQ ID NO: 81; (322) an exosporium protein comprising an amino acid sequence having at least 85% identity with SEQ ID NO: 82; (323) a targeting sequence comprising amino acids 2-38 of SEQ ID NO: 81; (324) a targeting sequence comprising amino acids 5-38 of SEQ ID NO: 81; (325) a targeting sequence comprising amino acids 10-38 of SEQ ID NO: 81; (326) a targeting sequence comprising amino acids 15-38 of SEQ ID NO: 81; (327) a targeting sequence comprising amino acids 20-38 of SEQ ID NO: 81; (328) a targeting sequence comprising amino acids 1-34 of SEQ ID NO: 83; (329) a targeting sequence comprising SEQ ID NO: 83; (330) an exosporium protein comprising an amino acid sequence having at least 85% identity with SEQ ID NO: 84; (331) an exosporium protein comprising an amino acid sequence having at least 85% identity with SEQ ID NO: 86; (332) a targeting sequence comprising amino acids 1-28 of SEQ ID NO: 87; (333) a targeting sequence comprising amino acids 13-28 of SEQ ID NO: 87; (334) a targeting sequence comprising SEQ ID NO: 87; (335) an exosporium protein comprising an amino acid sequence having at least 85% identity with SEQ ID NO: 88; (336) a targeting sequence comprising amino acids 2-28 of SEQ ID NO: 87; (337) a targeting sequence comprising amino acids 5-28 of SEQ ID NO: 87; (338) a targeting sequence comprising amino acids 10-28 of SEQ ID NO: 87; (339) a targeting sequence comprising amino acids 1-28 of SEQ ID NO: 89; (340) a targeting sequence comprising SEQ ID NO: 89; (341) an exosporium protein comprising an amino acid sequence having at least 85% identity with SEQ ID NO: 90; (342) a targeting sequence comprising amino acids 2-28 of SEQ ID NO: 89; (343) a targeting sequence comprising amino acids 5-28 of SEQ ID NO: 89; (344) a targeting sequence comprising amino acids 10-28 of SEQ ID NO: 89; (345) a targeting sequence comprising amino acids 1-93 of SEQ ID NO: 91; (346) a targeting sequence comprising SEQ ID NO: 91; (347) an exosporium protein comprising an amino acid sequence having at least 85% identity with SEQ ID NO: 92; (348) a targeting sequence comprising amino acids 2-93 of SEQ ID NO: 91; (349) a targeting sequence comprising amino acids 10-93 of SEQ ID NO: 91; (350) a targeting sequence comprising amino acids 20-93 of SEQ ID NO: 91; (351) a targeting sequence comprising amino acids 30-93 of SEQ ID NO: 91; (352) a targeting sequence comprising amino acids 40-93 of SEQ ID NO: 91; (353) a targeting sequence comprising amino acids 50-93 of SEQ ID NO: 91; (354) a targeting sequence comprising amino acids 60-93 of SEQ ID NO: 91; (355) a targeting sequence comprising amino acids 1-130 of SEQ ID NO: 93; (356) a targeting sequence comprising SEQ ID NO: 93; (357) an exosporium protein comprising an amino acid sequence having at least 85% identity with SEQ ID NO: 94; (358) a targeting sequence comprising amino acids 2-130 of SEQ ID NO: 93; (359) a targeting sequence comprising amino acids 10-130 of SEQ ID NO: 93; (360) a targeting sequence comprising amino acids 20-130 of SEQ ID NO: 93; (361) a targeting sequence comprising amino acids 30-130 of SEQ ID NO: 93; (362) an exosporium protein comprising an amino acid sequence having at least 85% identity with SEQ ID NO: 122; (363) a targeting sequence consisting of amino acids 20-33 of SEQ ID NO: 1; (364) a targeting sequence consisting of amino acids 21-33 of SEQ ID NO: 1; (365) a targeting sequence consisting of amino acids 23-31 of SEQ ID NO: 1; (366) a targeting sequence consisting of amino acids 1-15 of SEQ ID NO: 96; (367) a targeting sequence consisting of amino acids 1-13 of SEQ ID NO: 96; (368) a targeting sequence consisting of amino acids 12-25 of SEQ ID NO: 3; (369) a targeting sequence consisting of amino acids 13-25 of SEQ ID NO: 3; (370) a targeting sequence consisting of amino acids 15-23 of SEQ ID NO: 3; (371) a targeting sequence consisting of amino acids 1-15 of SEQ ID NO: 97; (372) a targeting sequence consisting of amino acids 1-13 of SEQ ID NO: 98; (373) a targeting sequence consisting of amino acids 23-36 of SEQ ID NO: 5; (374) a targeting sequence consisting of amino acids 23-34 of SEQ ID NO: 5; (375) a targeting sequence consisting of amino acids 24-36 of SEQ ID NO: 5; (376) a targeting sequence consisting of amino acids 26-34 of SEQ ID NO: 5; (377) a targeting sequence consisting of amino acids 13-26 of SEQ ID NO: 7; (378) a targeting sequence consisting of amino acids 13-24 of SEQ ID NO: 7; (379) a targeting sequence consisting of amino acids 14-26 of SEQ ID NO: 7; (380) a targeting sequence consisting of amino acids 16-24 of SEQ ID NO: 7; (381) a targeting sequence consisting of amino acids 9-22 of SEQ ID NO: 9; (382) a targeting sequence consisting of amino acids 9-20 of SEQ ID NO: 9; (383) a targeting sequence consisting of amino acids 10-22 of SEQ ID NO: 9; (384) a targeting sequence consisting of amino acids 12-20 of SEQ ID NO: 9; (385) a targeting sequence consisting of amino acids 1-15 of SEQ ID NO: 105; (386) a targeting sequence consisting of amino acids 1-13 of SEQ ID NO: 105; (387) a targeting sequence consisting of amino acids 18-31 of SEQ ID NO: 11; (388) a targeting sequence consisting of amino acids 18-29 of SEQ ID NO: 11; (389) a targeting sequence consisting of amino acids 19-31 of SEQ ID NO: 11; (390) a targeting sequence consisting of amino acids 1-15 of SEQ ID NO: 98; (391) a targeting sequence consisting of amino acids 1-13 of SEQ ID NO: 98; (392) a targeting sequence consisting of amino acids 18-31 of SEQ ID NO: 13; (393) a targeting sequence consisting of amino acids 18-29 of SEQ ID NO: 13; (394) a targeting sequence consisting of amino acids 19-31 of SEQ ID NO: 13; (395) a targeting sequence consisting of amino acids 21-29 of SEQ ID NO: 13; (396) a targeting sequence consisting of amino acids 1-15 of SEQ ID NO: 99; (397) a targeting sequence consisting of amino acids 1-13 of SEQ ID NO: 99; (398) a targeting sequence consisting of amino acids 28-41 of SEQ ID NO: 15; (399) a targeting sequence consisting of amino acids 28-39 of SEQ ID NO: 15; (400) a targeting sequence consisting of amino acids 29-41 of SEQ ID NO: 15; (401) a targeting sequence consisting of amino acids 31-39 of SEQ ID NO: 15; (402) a targeting sequence consisting of amino acids 12-25 of SEQ ID NO: 17; (403) a targeting sequence consisting of amino acids 13-25 of SEQ ID NO: 17; (404) a targeting sequence consisting of amino acids 1-15 of SEQ ID NO: 100; (405) a targeting sequence consisting of amino acids 18-31 of SEQ ID NO: 19; (406) a targeting sequence consisting of amino acids 18-29 of SEQ ID NO: 19; (407) a targeting sequence consisting of amino acids 19-31 of SEQ ID NO: 19; (408) a targeting sequence consisting of amino acids 21-29 of SEQ ID NO: 19; (409) a targeting sequence consisting of amino acids 18-31 of SEQ ID NO: 21; (410) a targeting sequence consisting of amino acids 18-29 of SEQ ID NO: 21; (411) a targeting sequence consisting of amino acids 19-31 of SEQ ID NO: 21; (412) a targeting sequence consisting of amino acids 21-29 of SEQ ID NO: 21; (413) a targeting sequence consisting of amino acids 1-15 of SEQ ID NO: 101; (414) a targeting sequence consisting of amino acids 1-13 of SEQ ID NO: 101; (415) a targeting sequence consisting of amino acids 9-22 of SEQ ID NO: 23; (416) a targeting sequence consisting of amino acids 9-20 of SEQ ID NO: 23; (417) a targeting sequence consisting of amino acids 10-22 of SEQ ID NO: 23; (418) a targeting sequence consisting of amino acids 12-20 of SEQ ID NO: 23; (419) a targeting sequence consisting of amino acids 1-15 of SEQ ID NO: 102; (420) a targeting sequence consisting of amino acids 1-13 of SEQ ID NO: 102; (421) a targeting sequence consisting of amino acids 9-22 of SEQ ID NO: 25; (422) a targeting sequence consisting of amino acids 9-20 of SEQ ID NO: 25; (423) a targeting sequence consisting of amino acids 10-22 of SEQ ID NO: 25; (424) a targeting sequence consisting of amino acids 12-20 of SEQ ID NO: 25; (425) a targeting sequence consisting of amino acids 1-15 of SEQ ID NO: 103; (426) a targeting sequence consisting of amino acids 1-13 of SEQ ID NO: 103; (427) a targeting sequence consisting of amino acids 15-28 of SEQ ID NO: 27; (428) a targeting sequence consisting of amino acids 15-26 of SEQ ID NO: 27; (429) a targeting sequence consisting of amino acids 16-28 of SEQ ID NO: 27; (430) a targeting sequence consisting of amino acids 18-26 of SEQ ID NO: 27; (431) a targeting sequence consisting of amino acids 1-15 of SEQ ID NO: 104; (432) a targeting sequence consisting of amino acids 1-13 of SEQ ID NO: 104; (433) a targeting sequence consisting of amino acids 1-13 of SEQ ID NO: 33; (434) a targeting sequence consisting of amino acids 1-11 of SEQ ID NO: 33; (435) a targeting sequence consisting of amino acids 3-11 of SEQ ID NO: 33; (436) a targeting sequence consisting of amino acids 1-14 of SEQ ID NO: 35; (437) a targeting sequence consisting of amino acids 1-12 of SEQ ID NO: 35; (438) a targeting sequence consisting of amino acids 2-14 of SEQ ID NO: 35; (439) a targeting sequence consisting of amino acids 14-27 of SEQ ID NO: 43; (440) a targeting sequence consisting of amino acids 14-25 of SEQ ID NO: 43; (441) a targeting sequence consisting of amino acids 15-27 of SEQ ID NO: 43; (442) a targeting sequence consisting of amino acids 20-33 of SEQ ID NO: 45; (443) a targeting sequence consisting of amino acids 20-31 of SEQ ID NO: 45; (444) a targeting sequence consisting of amino acids 21-33 of SEQ ID NO: 45; (445) a targeting sequence consisting of amino acids 1-15 of SEQ ID NO: 106; (446) a targeting sequence consisting of amino acids 1-13 of SEQ ID NO: 106; (447) a targeting sequence consisting of amino acids 28-41 of SEQ ID NO: 47; (448) a targeting sequence consisting of amino acids 28-39 of SEQ ID NO: 47; (449) a targeting sequence consisting of amino acids 18-31 of SEQ ID NO: 53; (450) a targeting sequence consisting of amino acids 18-29 of SEQ ID NO: 53; (451) a targeting sequence consisting of amino acids 19-31 of SEQ ID NO: 53; (452) a targeting sequence comprising amino acids 18-31 of SEQ ID NO: 61; (453) a targeting sequence comprising amino acids 18-29 of SEQ ID NO: 61; (454) a targeting sequence comprising amino acids 19-31 of SEQ ID NO: 61; (455) a targeting sequence comprising amino acids 9-22 of SEQ ID NO: 65; (456) a targeting sequence comprising amino acids 9-20 of SEQ ID NO: 65; (457) a targeting sequence comprising amino acids 10-22 of SEQ ID NO: 65; (458) a targeting sequence comprising amino acids 1-15 of SEQ ID NO: 107; (459) a targeting sequence comprising amino acids 1-13 of SEQ ID NO: 107; (460) a targeting sequence comprising amino acids 12-25 of SEQ ID NO: 67; (461) a targeting sequence comprising amino acids 12-23 of SEQ ID NO: 67; (462) a targeting sequence comprising amino acids 13-25 of SEQ ID NO: 67; (463) a targeting sequence comprising amino acids 15-23 of SEQ ID NO: 67; (464) a targeting sequence comprising amino acids 23-36 of SEQ ID NO: 69; (465) a targeting sequence comprising amino acids 23-34 of SEQ ID NO: 69; (466) a targeting sequence comprising amino acids 24-36 of SEQ ID NO: 69; (467) a targeting sequence comprising amino acids 26-34 of SEQ ID NO: 69; (468) a targeting sequence comprising amino acids 27-40 of SEQ ID NO: 75; (469) a targeting sequence comprising amino acids 27-38 of SEQ ID NO: 75; (470) a targeting sequence comprising amino acids 9-22 of SEQ ID NO: 77; (471) a targeting sequence comprising amino acids 9-20 of SEQ ID NO: 77; (472) a targeting sequence comprising amino acids 10-22 of SEQ ID NO: 77; (473) a targeting sequence comprising amino acids 12-20 of SEQ ID NO: 77; (474) a targeting sequence comprising amino acids 23-36 of SEQ ID NO: 81; (475) a targeting sequence comprising amino acids 23-34 of SEQ ID NO: 81; (476) a targeting sequence comprising amino acids 24-36 of SEQ ID NO: 81; (477) a targeting sequence comprising amino acids 26-34 of SEQ ID NO: 81; (478) a targeting sequence comprising amino acids 13-26 of SEQ ID NO: 87; (479) a targeting sequence comprising amino acids 13-24 of SEQ ID NO: 87; or (480) a targeting sequence comprising amino acids 14-26 of SEQ ID NO: 87; (481) a targeting sequence comprising SEQ ID NO: 371; (482) a targeting sequence comprising SEQ ID NO: 372; (483) an exosporium protein comprising an amino acid sequence having at least 85% identity with SEQ ID NO: 381; (484) an exosporium protein comprising an amino acid sequence having at least 85% identity with SEQ ID NO: 382; (485) an exosporium protein fragment comprising an amino acid sequence having at least 85% identity with SEQ ID NO: 383; (486) an exosporium protein comprising an amino acid sequence having at least 85% identity with SEQ ID NO: 384; or (487) an exosporium protein fragment comprising an amino acid sequence having at least 85% identity with SEQ ID NO:385.

For example, the targeting sequence can comprise an amino acid sequence having at least about 50% identity with amino acids 20-35 of SEQ ID NO: 1, wherein the identity with amino acids 25-35 is at least about 63%.

Alternatively, the targeting sequence can consist of an amino acid sequence having at least about 50% identity with amino acids 20-35 of SEQ ID NO: 1, wherein the identity with amino acids 25-35 is at least about 63%.

The targeting sequence can comprise an amino acid sequence having at least about 50% identity with amino acids 20-35 of SEQ ID NO: 1, wherein the identity with amino acids 25-35 is at least about 72%.

Alternatively, the targeting sequence can consist of an amino acid sequence having at least about 50% identity with amino acids 20-35 of SEQ ID NO: 1, wherein the identity with amino acids 25-35 is at least about 72%.

The targeting sequence can comprise an amino acid sequence having at least about 56% identity with amino acids 20-35 of SEQ ID NO: 1, wherein the identity with amino acids 25-35 is at least about 63%.

Alternatively, the targeting sequence can consist of an amino acid sequence having at least about 56% identity with amino acids 20-35 of SEQ ID NO: 1, wherein the identity with amino acids 25-35 is at least about 63%.

The targeting sequence can comprise an amino sequence having at least about 62% identity with amino acids 20-35 of SEQ ID NO: 1, wherein the identity with amino acids 25-35 is at least about 72%.

Alternatively, the targeting sequence can consist of an amino sequence having at least about 62% identity with amino acids 20-35 of SEQ ID NO: 1, wherein the identity with amino acids 25-35 is at least about 72%.

The targeting sequence can comprise an amino acid sequence having at least about 68% identity with amino acids 20-35 of SEQ ID NO: 1, wherein the identity with amino acids 25-35 is at least about 81%.

Alternatively, the targeting sequence can consist of an amino acid sequence having at least about 68% identity with amino acids 20-35 of SEQ ID NO: 1, wherein the identity with amino acids 25-35 is at least about 81%.

The targeting sequence can comprise an amino sequence having at least about 75% identity with amino acids 20-35 of SEQ ID NO: 1, wherein the identity with amino acids 25-35 is at least about 72%.

Alternatively, the targeting sequence can consist of an amino sequence having at least about 75% identity with amino acids 20-35 of SEQ ID NO: 1, wherein the identity with amino acids 25-35 is at least about 72%.

The targeting sequence can comprise an amino sequence having at least about 75% identity with amino acids 20-35 of SEQ ID NO: 1, wherein the identity with amino acids 25-35 is at least about 81%.

Alternatively, the targeting sequence can consist of an amino sequence having at least about 75% identity with amino acids 20-35 of SEQ ID NO: 1, wherein the identity with amino acids 25-35 is at least about 81%.

The targeting sequence can comprise an amino acid sequence having at least about 81% identity with amino acids 20-35 of SEQ ID NO:1, wherein the identity with amino acids 25-35 is at least about 81%.

Alternatively, the targeting sequence can consist of an amino acid sequence having at least about 81% identity with amino acids 20-35 of SEQ ID NO:1, wherein the identity with amino acids 25-35 is at least about 81%.

The targeting sequence can comprise an amino acid sequence having at least about 81% identity with amino acids 20-35 of SEQ ID NO: 1, wherein the identity with amino acids 25-35 is at least about 90%.

Alternatively, the targeting sequence can consist of an amino acid sequence having at least about 81% identity with amino acids 20-35 of SEQ ID NO: 1, wherein the identity with amino acids 25-35 is at least about 90%.

For example, the targeting sequence can consist of: (a) an amino acid sequence consisting of 16 amino acids and having at least about 43% identity with amino acids 20-35 of SEQ ID NO: 1, wherein the identity with amino acids 25-35 is at least about 54%; (b) amino acids 1-35 of SEQ ID NO: 1; (c) amino acids 20-35 of SEQ ID NO: 1; (d) SEQ ID NO: 1; (e) SEQ ID NO: 96; or (f) SEQ ID NO: 120.

In any of the fusion proteins described herein, the fusion protein can comprise an exosporium protein or an exosporium protein fragment comprising an amino acid sequence having at least 90% identity with SEQ ID NO: 2, 4, 6, 8, 10, 12, 14, 16, 18, 20, 22, 24, 26, 28, 30, 32, 34, 36, 44, 46, 48, 50, 52, 54, 56, 58, 95, 108, 109, 110, 111, 112, 113, 114, 115, 116, 117, 118, 119, 120, and 121.

The fusion protein can comprise an exosporium protein or an exosporium protein fragment comprising an amino acid sequence having at least 95% identity with SEQ ID NO: 2, 4, 6, 8, 10, 12, 14, 16, 18, 20, 22, 24, 26, 28, 30, 32, 34, 36, 44, 46, 48, 50, 52, 54, 56, 58, 95, 108, 109, 110, 111, 112, 113, 114, 115, 116, 117, 118, 119, 120, and 121.

The fusion protein can comprise an exosporium protein or an exosporium protein fragment comprising an amino acid sequence having at least 98% identity with SEQ ID NO: 2, 4, 6, 8, 10, 12, 14, 16, 18, 20, 22, 24, 26, 28, 30, 32, 34, 36, 44, 46, 48, 50, 52, 54, 56, 58, 95, 108, 109, 110, 111, 112, 113, 114, 115, 116, 117, 118, 119, 120, and 121.

The fusion protein can comprise an exosporium protein or an exosporium protein fragment comprising an amino acid sequence having at least 99% identity with SEQ ID NO: 2, 4, 6, 8, 10, 12, 14, 16, 18, 20, 22, 24, 26, 28, 30, 32, 34, 36, 44, 46, 48, 50, 52, 54, 56, 58, 95, 108, 109, 110, 111, 112, 113, 114, 115, 116, 117, 118, 119, 120, and 121.

The fusion protein can comprise an exosporium protein or an exosporium protein fragment comprising an amino acid sequence having 100% identity with SEQ ID NO: 2, 4, 6, 8, 10, 12, 14, 16, 18, 20, 22, 24, 26, 28, 30, 32, 34, 36, 44, 46, 48, 50, 52, 54, 56, 58, 95, 108, 109, 110, 111, 112, 113, 114, 115, 116, 117, 118, 119, 120, and 121.

In any of the fusion proteins described herein, the fusion protein can comprise an exosporium protein comprising an amino acid sequence having at least 90% identity with SEQ ID NO: 60, 62, 64, 66, 68, 70, 76, 78, 80, 82, 84, 86, 88, 90, 92, 94, or 122.

The fusion protein can comprise an exosporium protein comprising an amino acid sequence having at least 95% identity with SEQ ID NO: 60, 62, 64, 66, 68, 70, 76, 78, 80, 82, 84, 86, 88, 90, 92, 94, or 122.

The fusion protein can comprise an exosporium protein comprising an amino acid sequence having at least 98% identity with SEQ ID NO: 60, 62, 64, 66, 68, 70, 76, 78, 80, 82, 84, 86, 88, 90, 92, 94, or 122.

The fusion protein can comprise an exosporium protein comprising an amino acid sequence having at least 99% identity with SEQ ID NO: 60, 62, 64, 66, 68, 70, 76, 78, 80, 82, 84, 86, 88, 90, 92, 94, or 122.

The fusion protein can comprise an exosporium protein comprising an amino acid sequence having 100% identity with SEQ ID NO: 60, 62, 64, 66, 68, 70, 76, 78, 80, 82, 84, 86, 88, 90, 92, 94, or 122.

In any of the fusion proteins described herein, the fusion protein can comprise an exosporium protein or an exosporium protein fragment comprising an amino acid sequence having at least 90% identity with any one of SEQ ID NOs. 381-385.

The fusion protein can comprise an exosporium protein or an exosporium protein fragment comprising an amino acid sequence having at least 95% identity with any one of SEQ ID NOs. 381-385

The fusion protein can comprise an exosporium protein or an exosporium protein fragment comprising an amino acid sequence having at least 98% identity with any one of SEQ ID NOs. 381-385

The fusion protein can comprise an exosporium protein or an exosporium protein fragment comprising an amino acid sequence having at least 99% identity with any one of SEQ ID NOs. 381-385

The fusion protein can comprise an exosporium protein or an exosporium protein fragment comprising an amino acid sequence having 100% identity with any one of SEQ ID NOs. 381-385.

In any of the fusion proteins described herein, the targeting sequence, exosporium protein, or exosporium protein fragment can comprise the amino acid sequence GXT at its carboxy terminus, wherein X is any amino acid.

In any of the fusion proteins described herein, the targeting sequence, exosporium protein, or exosporium protein fragment can comprise an alanine residue at the position of the targeting sequence that corresponds to amino acid 20 of SEQ ID NO: 1.

In any of the fusion proteins described herein, the targeting sequence, exosporium protein, or exosporium protein fragment can further comprise a methionine, serine, or threonine residue at the amino acid position immediately preceding the first amino acid of the targeting sequence, exosporium protein, or exosporium protein fragment or at the position of the targeting sequence that corresponds to amino acid 20 of SEQ ID NO: 1.

1. Fusion Proteins Comprising an Enzyme Having ACC Deaminase Activity

Fusion proteins comprising a targeting sequence, exosporium protein, or exosporium protein fragment that targets the fusion protein to the exosporium of a recombinant *Bacillus cereus* family member and an enzyme having 1-aminocyclopropane-1-carboxylate deaminase (ACC deaminase) activity are provided.

Where the fusion protein comprises an enzyme having ACC deaminase activity, the enzyme having ACC deaminase activity can comprise an amino acid sequence comprising at least one amino acid substitution relative to the sequence of a wild-type D-cysteine desulfhydrase or ACC deaminase enzyme from a *Bacillus* genus bacterium, wherein the amino acid substitution results in increased ACC deaminase activity as compared to the ACC deaminase activity of the wild-type D-cysteine desulfhydrase or ACC deaminase enzyme under the same conditions.

For example, the amino acid sequence of the enzyme can comprise two amino acid substitutions relative to the sequence of the wild-type D-cysteine desulfhydrase or ACC deaminase enzyme, wherein the amino acid substitutions result in increased ACC deaminase activity as compared to the ACC deaminase activity of the wild-type enzyme under the same conditions.

The amino acid sequence of the enzyme can comprise a substitution of the threonine residue at position 290 of SEQ ID NO: 242 with a glutamic acid residue and a substitution of the serine residue at position 317 of SEQ ID NO: 242 with a leucine residue.

The amino acid sequence of the enzyme can comprise a substitution of the threonine residue at position 290 of SEQ ID NO: 243 with a glutamic acid residue and a substitution of the serine residue at position 317 of SEQ ID NO: 243 with a leucine residue.

The amino acid sequence of the enzyme can comprise a substitution of the threonine residue at position 290 of SEQ ID NO: 244 with a glutamic acid residue and a substitution of the serine residue at position 317 of SEQ ID NO: 244 with a leucine residue.

The amino acid sequence of the enzyme can comprise a substitution of the threonine residue at position 290 of SEQ ID NO: 245 with a glutamic acid residue and a substitution of the serine residue at position 317 of SEQ ID NO: 245 with a leucine residue.

The enzyme can comprise SEQ ID NO: 246, 247, 248, or 249.

For example, the enzyme can comprise SEQ ID NO: 249.

Alternatively, the enzyme can consist of SEQ ID NO: 246, 247, 248, or 249.

For example, the enzyme can consist of SEQ ID NO: 249.

Alternatively or in addition, the enzyme having ACC deaminase activity can comprise a *Bacillus* enzyme (e.g., a *Bacillus thuringiensis* enzyme or a *Bacillus pseudomycoides* enzyme).

Alternatively or in addition, the enzyme having ACC deaminase activity can comprise an amino acid sequence having at least 70% identity to any one of SEQ ID NOs. 242-245.

For example, the enzyme having ACC deaminase activity can comprise an amino acid sequence having at least 75% identity to any one of SEQ ID NOs. 242-245.

The enzyme having ACC deaminase activity can comprise an amino acid sequence having at least 80% identity to any one of SEQ ID NOs. 242-245.

The enzyme having ACC deaminase activity can comprise an amino acid sequence having at least 85% identity to any one of SEQ ID NOs. 242-245.

The enzyme having ACC deaminase activity can comprise an amino acid sequence having at least 90% identity to any one of SEQ ID NOs. 242-245.

The enzyme having ACC deaminase activity can comprise an amino acid sequence having at least 95% identity to any one of SEQ ID NOs. 242-245.

The enzyme having ACC deaminase activity can comprise an amino acid sequence having at least 98% identity to any one of SEQ ID NOs. 242-245.

The enzyme having ACC deaminase activity can comprise an amino acid sequence having at least 99% identity to any one of SEQ ID NOs. 242-245.

The enzyme having ACC deaminase activity can comprise an amino acid sequence having 100% identity to any one of SEQ ID NOs. 242-245.

For example, the enzyme can comprise SEQ ID NO: 245.

Alternatively, the enzyme can consist of SEQ ID NO: 245.

2. Fusion Proteins Comprising a Phospholipase

Fusion proteins comprising a targeting sequence, exosporium protein, or exosporium protein fragment that targets the fusion protein to the exosporium of a recombinant *Bacillus cereus* family member and a phospholipase are provided.

Where the fusion protein comprises a phospholipase, the phospholipase can comprise a phospholipase B.

For example, the phospholipase B can comprise a phospholipase B1.

Where the fusion protein comprises a phospholipase, the phospholipase can comprise a phospholipase C. The phospholipase C comprises a phospholipase C beta 1, a phospholipase C beta 2, a phospholipase C beta 3, a phospholipase C beta 4, a phospholipase C delta 1, a phospholipase C delta 3, a phospholipase C delta 4, a phospholipase C epsilon 1, a phospholipase C gamma 1, a phospholipase C gamma 2, a phospholipase C eta 1, a phospholipase C eta 2, a phospholipase C zeta 1, or a combination of any thereof.

Where the fusion protein comprises a phospholipase, the phospholipase can comprise a phospholipase D. The phospholipase D comprises a phospholipase D1, a phospholipase D2, a phospholipase D member 3, a phospholipase D member 4, a phospholipase D member 5, a phospholipase D member 6, or a combination of any thereof.

Where the fusion protein comprises a phospholipase, the phospholipase can comprise a phospholipase A2. The phospholipase A2 comprises a Group IIA phospholipase A2, a Group IIC phospholipase A2, a Group IID phospholipase A2, a Group IIE phospholipase A2, a Group IIF phospholipase A2, a Group III phospholipase A2, a Group IVA phospholipase A2, a Group IVB phospholipase A2, a Group IVC phospholipase A2, a Group IVD phospholipase A2, a Group IVE phospholipase A2, a Group VIF phospholipase A2, a Group V phospholipase A2, a Group VI phospholipase A2, a Group VII phospholipase A2, a Group X phospholipase A2, a Group XIIA phospholipase A2, a Group XIIB phospholipase A2, a Group XV phospholipase A2, a Group XVI phospholipase A2, or a combination of any thereof.

Where the fusion protein comprises a phospholipase, the phospholipase can comprise a 1-alkyl-2-acetylglycerophosphocholine esterase.

Where the fusion protein comprises a phospholipase, the phospholipase can comprise a phosphatidylinositol deacylase.

Where the fusion protein comprises a phospholipase, the phospholipase can comprise a phosphatidylinoslitol-specific phospholipase C. For example, the phosphatidylinoslitol-specific phospholipase C can comprise a *Bacillus thuringiensis* phosphatidylinoslitol-specific phospholipase C.

Where the fusion protein comprises a phospholipase, the phospholipase can comprise a sphingomyelin phosphodiesterase.

Where the fusion protein comprises a phospholipase, the phospholipase can comprise a sphingomyelin phosphodiesterase D.

Where the fusion protein comprises a phospholipase, the phospholipase can comprise an alkylglycerophosphoethanolamine phosphodiesterase.

Where the fusion protein comprises a phospholipase, the phospholipase can comprise a variant-surface-glycoprotein phospholipase C.

Where the fusion protein comprises a phospholipase, the phospholipase can comprise a glycosylphosphatidylinositol phospholipase D.

Where the fusion protein comprises a phospholipase, the phospholipase can comprise an N-acetylphosphatidylethanolamine-hydrolysing phospholipase D.

Where the fusion protein comprises a phospholipase, the phospholipase can comprise a phosphatidylinositol diacylglycerol-lyase.

Where the fusion protein comprises a phospholipase, the phospholipase can comprise a glycosylphosphatidylinositol diacylglycerol-lyase.

Where the fusion protein comprises a phospholipase, the phospholipase can comprise a patatin-like phospholipase domain containing protein 2 (PNPLA2).

Where the fusion protein comprises a phospholipase, the phospholipase can comprise a patatin-like phospholipase domain containing protein 3 (PNPLA3).

Where the fusion protein comprises a phospholipase, the phospholipase can comprise a *Streptomyces* phospholipase.

Where the fusion protein comprises a phospholipase, the phospholipase can comprise a *Clostridium* phospholipase. For example, the phospholipase can comprise a *Streptomyces chromofuscus* phospholipase (e.g., a *Streptomyces chromofuscus* phospholipase).

Where the fusion protein comprises a phospholipase, the phospholipase can comprise an *Acidovorax* phospholipase. For example, the phospholipase can comprise a *Clostridium perfringens* phospholipase (e.g., a *Clostridium perfringens* phospholipase C).

Where the fusion protein comprises a phospholipase, the phospholipase can comprise a *Listeria* phospholipase. For example, the phospholipase can comprise a *Listeria monocytogenes* phospholipase (e.g., a *Listeria monocytogenes* phospholipase C).

Where the fusion protein comprises a phospholipase, the phospholipase can comprise a *Bacillus cereus* phospholipase. For example, the phospholipase can comprise a *Bacillus cereus* phosphatidylcholine-specific phospholipase C or a *Bacillus cereus* phosphatidylinositol-specific phospholipase C.

Where the fusion protein comprises a phospholipase, the phospholipase can comprise a *Bacillus licheniformis* phospholipase.

Where the fusion protein comprises a phospholipase, the phospholipase can comprise an amino acid sequence having at least 70% identity to any one of SEQ ID NOs. 252-260 and 373-375.

For example, the phospholipase can comprise an amino acid sequence having at least 75% identity to any one of SEQ ID NOs. 252-260 and 373-375.

The phospholipase can comprise an amino acid sequence having at least 80% identity to any one of SEQ ID NOs. 252-260 and 373-375.

The phospholipase can comprise an amino acid sequence having at least 85% identity to any one of SEQ ID NOs. 252-260 and 373-375.

The phospholipase can comprise an amino acid sequence having at least 90% identity to any one of SEQ ID NOs. 252-260 and 373-375.

The phospholipase can comprise an amino acid sequence having at least 95% identity to any one of SEQ ID NOs. 252-260 and 373-375.

The phospholipase can comprise an amino acid sequence having at least 98% identity to any one of SEQ ID NOs. 252-260 and 373-375.

The phospholipase can comprise an amino acid sequence having at least 99% identity to any one of SEQ ID NOs. 252-260 and 373-375.

The phospholipase can comprise an amino acid sequence having 100% identity to any one of SEQ ID NOs. 252-260 and 373-375.

Where the fusion protein comprises a phospholipase, the phospholipase can comprise an amino acid sequence having at least 70% identity to any one of SEQ ID NOs. 373-375.

For example, the phospholipase can comprise an amino acid sequence having at least 75% identity to any one of SEQ ID NOs. 373-375.

The phospholipase can comprise an amino acid sequence having at least 80% identity to any one of SEQ ID NOs. 373-375.

The phospholipase can comprise an amino acid sequence having at least 85% identity to any one of SEQ ID NOs. 373-375.

The phospholipase can comprise an amino acid sequence having at least 90% identity to any one of SEQ ID NOs 373-375.

The phospholipase can comprise an amino acid sequence having at least 95% identity to any one of SEQ ID NOs. 373-375.

The phospholipase can comprise an amino acid sequence having at least 98% identity to any one of SEQ ID NOs. 373-375.

The phospholipase can comprise an amino acid sequence having at least 99% identity to any one of SEQ ID NOs. 373-375.

The phospholipase can comprise an amino acid sequence having 100% identity to any one of SEQ ID NOs. 373-375.

Where the fusion protein comprises a phospholipase, the phospholipase can consist essentially of an amino acid sequence having at least 70% identity to SEQ ID NO: 250 or 251.

For example, the phospholipase can consist essentially of an amino acid sequence having at least 75% identity to SEQ ID NO: 250 or 251.

The phospholipase can consist essentially of an amino acid sequence having at least 80% identity to SEQ ID NO: 250 or 251.

The phospholipase can consist essentially of an amino acid sequence having at least 85% identity to SEQ ID NO: 250 or 251.

The phospholipase can consist essentially of an amino acid sequence having at least 90% identity to SEQ ID NO: 250 or 251.

The phospholipase can consist essentially of an amino acid sequence having at least 95% identity to SEQ ID NO: 250 or 251.

The phospholipase can consist essentially of an amino acid sequence having at least 98% identity to SEQ ID NO: 250 or 251.

The phospholipase can consist essentially of an amino acid sequence having at least 99% identity to SEQ ID NO: 250 or 251.

The phospholipase can consist essentially of an amino acid sequence having 100% identity to SEQ ID NO: 250 or 251.

Where the fusion protein comprises a phospholipase, the phospholipase can consist of an amino acid sequence having at least 70% identity to SEQ ID NO: 250.

For example, the phospholipase can consist of an amino acid sequence having at least 75% identity to SEQ ID NO: 250.

The phospholipase can consist of an amino acid sequence having at least 80% identity to SEQ ID NO: 250.

The phospholipase can consist of an amino acid sequence having at least 85% identity to SEQ ID NO: 250.

The phospholipase can consist of an amino acid sequence having at least 90% identity to SEQ ID NO: 250.

The phospholipase can consist of an amino acid sequence having at least 95% identity to SEQ ID NO: 250.

The phospholipase can consist of an amino acid sequence having at least 98% identity to SEQ ID NO: 250.

The phospholipase can consist of an amino acid sequence having at least 99% identity to SEQ ID NO: 250.

The phospholipase can consist of an amino acid sequence having 100% identity to SEQ ID NO: 250.

Where the fusion protein comprises a phospholipase, the phospholipase can consist of an amino acid sequence having at least 70% identity to SEQ ID NO: 251.

For example, the phospholipase can consist of an amino acid sequence having at least 75% identity to SEQ ID NO: 251.

The phospholipase can consist of an amino acid sequence having at least 80% identity to SEQ ID NO: 251.

The phospholipase can consist of an amino acid sequence having at least 85% identity to SEQ ID NO: 251.

The phospholipase can consist of an amino acid sequence having at least 90% identity to SEQ ID NO: 251.

The phospholipase can consist of an amino acid sequence having at least 95% identity to SEQ ID NO: 251.

The phospholipase can consist of an amino acid sequence having at least 98% identity to SEQ ID NO: 251.

The phospholipase can consist of an amino acid sequence having at least 99% identity to SEQ ID NO: 251.

The phospholipase can consist of an amino acid sequence having 100% identity to SEQ ID NO: 251.

Where the fusion protein comprises a phospholipase, the phospholipase can comprise an amino acid sequence having at least 70% identity to SEQ ID NO: 256 or 260.

For example, the phospholipase can comprise an amino acid sequence having at least 75% identity to SEQ ID NO: 256 or 260.

The phospholipase can comprise an amino acid sequence having at least 80% identity to SEQ ID NO: 256 or 260.

The phospholipase can comprise an amino acid sequence having at least 85% identity to SEQ ID NO: 256 or 260.

The phospholipase can comprise an amino acid sequence having at least 90% identity to SEQ ID NO: 256 or 260.

The phospholipase can comprise an amino acid sequence having at least 95% identity to SEQ ID NO: 256 or 260.

The phospholipase can comprise an amino acid sequence having at least 98% identity to SEQ ID NO: 256 or 260.

The phospholipase can comprise an amino acid sequence having at least 99% identity to SEQ ID NO: 256 or 260.

The phospholipase can comprise an amino acid sequence having at 100% identity to SEQ ID NO: 256 or 260.

Where the fusion protein comprises a phospholipase, the phospholipase can comprise an amino acid sequence having at least 70% identity to SEQ ID NO: 256.

For example, the phospholipase can comprise an amino acid sequence having at least 75% identity to SEQ ID NO: 256.

The phospholipase can comprise an amino acid sequence having at least 80% identity to SEQ ID NO: 256.

The phospholipase can comprise an amino acid sequence having at least 85% identity to SEQ ID NO: 256.

The phospholipase can comprise an amino acid sequence having at least 90% identity to SEQ ID NO: 256.

The phospholipase can comprise an amino acid sequence having at least 95% identity to SEQ ID NO: 256.

The phospholipase can comprise an amino acid sequence having at least 98% identity to SEQ ID NO: 256.

The phospholipase can comprise an amino acid sequence having at least 99% identity to SEQ ID NO: 256.

The phospholipase can comprise an amino acid sequence having 100% identity to SEQ ID NO: 256.

3. Fusion Proteins Comprising a Lipase

Fusion proteins comprising a targeting sequence, exosporium protein, or exosporium protein fragment that targets the fusion protein to the exosporium of a recombinant *Bacillus cereus* family member and a lipase are provided.

Where the fusion protein comprises a lipase, the lipase can comprise a carboxyl ester lipase.

Where the fusion protein comprises a lipase, the lipase can comprise a diacylglycerol lipase alpha.

Where the fusion protein comprises a lipase, the lipase can comprise a diacylglycerol lipase beta.

Where the fusion protein comprises a lipase, the lipase can comprise a lipase A.

Where the fusion protein comprises a lipase, the lipase can comprise a hepatic lipase.

Where the fusion protein comprises a lipase, the lipase can comprise a hormone-sensitive lipase.

Where the fusion protein comprises a lipase, the lipase can comprise a gastric lipase.

Where the fusion protein comprises a lipase, the lipase can comprise an endothelial lipase.

Where the fusion protein comprises a lipase, the lipase can comprise member H lipase.

Where the fusion protein comprises a lipase, the lipase can comprise a lipase family member I.

Where the fusion protein comprises a lipase, the lipase can comprise a lipase family member J.

Where the fusion protein comprises a lipase, the lipase can comprise a lipase family member K.

Where the fusion protein comprises a lipase, the lipase can comprise a lipase family member M.

Where the fusion protein comprises a lipase, the lipase can comprise a lipase family member N.

Where the fusion protein comprises a lipase, the lipase can comprise a lipoprotein lipase.

Where the fusion protein comprises a lipase, the lipase can comprise a monoglyceride lipase.

Where the fusion protein comprises a lipase, the lipase can comprise a pancreatic lipase-related protein 2.

Where the fusion protein comprises a lipase, the lipase can comprise a pancreatic lipase-related protein 3.

Where the fusion protein comprises a lipase, the lipase can comprise an acylglycerol lipase.

Where the fusion protein comprises a lipase, the lipase can comprise a galactolipase.

Where the fusion protein comprises a lipase, the lipase can comprise a lipoprotein lipase.

Where the fusion protein comprises a lipase, the lipase can comprise a *Burkholderia cepacia* lipase.

Where the fusion protein comprises a lipase, the lipase can comprise a *Burkholderia stearothermophilus* lipase.

Where the fusion protein comprises a lipase, the lipase can comprise *Pseudomonas* lipase.

Where the fusion protein comprises a lipase, the lipase can comprise an amino acid sequence having at least 70% identity to any one of SEQ ID NOs. 262-266.

For example, the lipase can comprise an amino acid sequence having at least 75% identity to any one of SEQ ID NOs. 262-266.

The lipase can comprise an amino acid sequence having at least 80% identity to any one of SEQ ID NOs. 262-266.

The lipase can comprise an amino acid sequence having at least 85% identity to any one of SEQ ID NOs. 262-266.

The lipase can comprise an amino acid sequence having at least 90% identity to any one of SEQ ID NOs. 262-266.

The lipase can comprise an amino acid sequence having at least 95% identity to any one of SEQ ID NOs. 262-266.

The lipase can comprise an amino acid sequence having at least 98% identity to any one of SEQ ID NOs. 262-266.

The lipase can comprise an amino acid sequence having at least 99% identity to any one of SEQ ID NOs. 262-266.

The lipase can comprise an amino acid sequence having 100% identity to any one of SEQ ID NOs. 262-266.

4. Fusion Proteins Comprising a Xylanase

Fusion proteins comprising a targeting sequence, exosporium protein, or exosporium protein fragment that targets the fusion protein to the exosporium of a recombinant *Bacillus cereus* family member and a xylanase are provided.

Where the fusion protein comprises a xylanase, the xylanase can comprise a beta-xylanase.

For example, the beta-xylanase can comprise a glucuronoarabinoxylan endo-1,4-beta-xylanase, an exo-1,4-beta-xylanase, an endo-1,4-beta-xylanase, or a combination of any thereof.

Where the fusion protein comprises a xylanase, the xylanase can comprise a *Caldicellulosiruptor* xylanase (e.g., a *Caldicellulosiruptor saccharolyticus* xylanase).

Where the fusion protein comprises a xylanase, the xylanase can comprise a *Bacillus* xylanase (e.g., a *Bacillus subtilis* or *Bacillus stearothermophilus* xylanase).

Where the fusion protein comprises a xylanase, the xylanase can comprise a *Neocallimastix* xylanase (e.g., a *Neocallimastix patriciarum* xylanase).

Where the fusion protein comprises a xylanase, the xylanase can comprise a *Thermomyces* xylanase (e.g., a *Thermomyces lanuginosus* xylanase).

Where the fusion protein comprises a xylanase, the xylanase can comprise an amino acid sequence having at least 70% identity to any one of SEQ ID NOs. 267-273.

For example, the xylanase can comprise an amino acid sequence having at least 75% identity to any one of SEQ ID NOs. 267-273.

The xylanase can comprise an amino acid sequence having at least 80% identity to any one of SEQ ID NOs. 267-273.

The xylanase can comprise an amino acid sequence having at least 85% identity to any one of SEQ ID NOs. 267-273.

The xylanase can comprise an amino acid sequence having at least 90% identity to any one of SEQ ID NOs. 267-273.

The xylanase can comprise an amino acid sequence having at least 95% identity to any one of SEQ ID NOs. 267-273.

The xylanase can comprise an amino acid sequence having at least 98% identity to any one of SEQ ID NOs. 267-273.

The xylanase can comprise an amino acid sequence having at least 99% identity to any one of SEQ ID NOs. 267-273.

The xylanase can comprise an amino acid sequence having 100% identity to any one of SEQ ID NOs. 267-273.

Where the fusion protein comprises a xylanase, the xylanase can comprise an amino acid sequence having at least 70% identity to SEQ ID NO: 268 or 273.

For example, the xylanase can comprise an amino acid sequence having at least 75% identity to SEQ ID NO: 268 or 273.

The xylanase can comprise an amino acid sequence having at least 80% identity to SEQ ID NO: 268 or 273.

The xylanase can comprise an amino acid sequence having at least 85% identity to SEQ ID NO: 268 or 273.

The xylanase can comprise an amino acid sequence having at least 90% identity to SEQ ID NO: 268 or 273.

The xylanase can comprise an amino acid sequence having at least 95% identity to SEQ ID NO: 268 or 273.

The xylanase can comprise an amino acid sequence having at least 98% identity to SEQ ID NO: 268 or 273.

The xylanase can comprise an amino acid sequence having at least 99% identity to SEQ ID NO: 268 or 273.

The xylanase can comprise an amino acid sequence having 100% identity to SEQ ID NO: 268 or 273.

Where the fusion protein comprises a xylanase, the xylanase can comprise an amino acid sequence having at least 70% identity to SEQ ID NO: 268.

For example, the xylanase can comprise an amino acid sequence having at least 75% identity to SEQ ID NO: 268.

The xylanase can comprise an amino acid sequence having at least 80% identity to SEQ ID NO: 268.

The xylanase can comprise an amino acid sequence having at least 85% identity to SEQ ID NO: 268.

The xylanase can comprise an amino acid sequence having at least 90% identity to SEQ ID NO: 268.

The xylanase can comprise an amino acid sequence having at least 95% identity to SEQ ID NO: 268.

The xylanase can comprise an amino acid sequence having at least 98% identity to SEQ ID NO: 268.

The xylanase can comprise an amino acid sequence having at least 99% identity to SEQ ID NO: 268.

The xylanase can comprise an amino acid sequence having 100% identity to SEQ ID NO: 268.

5. Fusion Proteins Comprising a Xylosidase

Fusion proteins comprising a targeting sequence, exosporium protein, or exosporium protein fragment that targets the fusion protein to the exosporium of a recombinant *Bacillus cereus* family member and a xylosidase are provided.

Where the fusion protein comprises a xylosidase, the xylosidase can comprise a *Caldicellulosiruptor saccharolyticus* xylosidase.

Where the fusion protein comprises a xylosidase, the xylosidase can comprise a *Bacillus pumilus* xylosidase.

Where the fusion protein comprises a xylosidase, the xylosidase can comprise a *Bacillus subtilis* xylosidase.

Where the fusion protein comprises a xylosidase, the xylosidase can comprise an amino acid sequence having at least 70% identity to any one of SEQ ID NOs. 274-276.

For example, the xylosidase can comprise an amino acid sequence having at least 75% identity to any one of SEQ ID NOs. 274-276.

The xylosidase can comprise an amino acid sequence having at least 80% identity to any one of SEQ ID NOs. 274-276.

The xylosidase can comprise an amino acid sequence having at least 85% identity to any one of SEQ ID NOs. 274-276.

The xylosidase can comprise an amino acid sequence having at least 90% identity to any one of SEQ ID NOs. 274-276.

The xylosidase can comprise an amino acid sequence having at least 95% identity to any one of SEQ ID NOs. 274-276.

The xylosidase can comprise an amino acid sequence having at least 98% identity to any one of SEQ ID NOs. 274-276.

The xylosidase can comprise an amino acid sequence having at least 99% identity to any one of SEQ ID NOs. 274-276.

The xylosidase can comprise an amino acid sequence having 100% identity to any one of SEQ ID NOs. 274-276.

Where the fusion protein comprises a xylosidase, the xylosidase can comprise an amino acid sequence having at least 70% identity to SEQ ID NO: 275.

For example, the xylosidase can comprise an amino acid sequence having at least 75% identity to SEQ ID NO: 275.

The xylosidase can comprise an amino acid sequence having at least 80% identity to SEQ ID NO: 275.

The xylosidase can comprise an amino acid sequence having at least 85% identity to SEQ ID NO: 275.

The xylosidase can comprise an amino acid sequence having at least 90% identity to SEQ ID NO: 275.

The xylosidase can comprise an amino acid sequence having at least 95% identity to SEQ ID NO: 275.

The xylosidase can comprise an amino acid sequence having at least 98% identity to SEQ ID NO: 275.

The xylosidase can comprise an amino acid sequence having at least 99% identity to SEQ ID NO: 275.

The xylosidase can comprise an amino acid sequence having 100% identity to SEQ ID NO: 275.

Where the fusion protein comprises a xylosidase, the xylosidase can comprise an amino acid sequence having at least 70% identity to SEQ ID NO: 276.

For example, the xylosidase can comprise an amino acid sequence having at least 75% identity to SEQ ID NO: 276.

The xylosidase can comprise an amino acid sequence having at least 80% identity to SEQ ID NO: 276.

The xylosidase can comprise an amino acid sequence having at least 85% identity to SEQ ID NO: 276.

The xylosidase can comprise an amino acid sequence having at least 90% identity to SEQ ID NO: 276.

The xylosidase can comprise an amino acid sequence having at least 95% identity to SEQ ID NO: 276.

The xylosidase can comprise an amino acid sequence having at least 98% identity to SEQ ID NO: 276.

The xylosidase can comprise an amino acid sequence having at least 99% identity to SEQ ID NO: 276.

The xylosidase can comprise an amino acid sequence having 100% identity to SEQ ID NO: 276.

6. Fusion Proteins Comprising a Lactonase

Fusion proteins comprising a targeting sequence, exosporium protein, or exosporium protein fragment that targets the fusion protein to the exosporium of a recombinant *Bacillus cereus* family member and a lactonase are provided.

Where the fusion protein comprises a lactonase, the lactonase can comprise a *Bacillus* lactonase (e.g., a *Bacillus thuringiensis* lactonase, a *Bacillus pseudomycoides* lactonase, or a combination thereof).

For example, the lactonase can comprise an AiiA lactonase.

Where the fusion protein comprises a lactonase, the lactonase can comprise an *Agrobacterium* lactonase.

Where the fusion protein comprises a lactonase, the lactonase can comprise a *Rhodococcus* lactonase.

Where the fusion protein comprises a lactonase, the lactonase can comprise a *Streptomyces* lactonase.

Where the fusion protein comprises a lactonase, the lactonase can comprise an *Arthrobacter* lactonase.

Where the fusion protein comprises a lactonase, the lactonase can comprise a *Sphingomonas* lactonase.

Where the fusion protein comprises a lactonase, the lactonase can comprise a *Pseudomonas* lactonase.

Where the fusion protein comprises a lactonase, the lactonase can comprise a *Klebsiella* lactonase.

For example, the lactonase can comprise an *Agrobacterium* lactonase, a *Rhodococcus* lactonase, a *Streptomyces* lactonase, an *Arthrobacter* lactonase, a *Sphingomonas* lactonase, a *Pseudomonas* lactonase, a *Klebsiella* lactonase, or a combination of any thereof.

Where the fusion protein comprises a lactonase, the lactonase can comprise an amino acid sequence having at least 70% identity to SEQ ID NO: 277 or 278.

For example, the lactonase can comprise an amino acid sequence having at least 75% identity to SEQ ID NO: 277 or 278.

The lactonase can comprise an amino acid sequence having at least 80% identity to SEQ ID NO: 277 or 278.

The lactonase can comprise an amino acid sequence having at least 85% identity to SEQ ID NO: 277 or 278.

The lactonase can comprise an amino acid sequence having at least 90% identity to SEQ ID NO: 277 or 278.

The lactonase can comprise an amino acid sequence having at least 95% identity to SEQ ID NO: 277 or 278.

The lactonase can comprise an amino acid sequence having at least 98% identity to SEQ ID NO: 277 or 278.

The lactonase can comprise an amino acid sequence having at least 99% identity to SEQ ID NO: 277 or 278.

The lactonase can comprise an amino acid sequence having 100% identity to SEQ ID NO: 277 or 278.

Where the fusion protein comprises a lactonase, the lactonase can comprise a lactonase that is specific for a bacterial lactone homoserine signaling molecule.

7. Fusion Proteins Comprising a Chitosanase

Fusion proteins comprising a targeting sequence, exosporium protein, or exosporium protein fragment that targets the fusion protein to the exosporium of a recombinant *Bacillus cereus* family member and a chitosanase are provided.

Where the fusion protein comprises a chitosanase, the chitosanase can comprise an exo-1,4-beta-D-glucosaminidase.

Where the fusion protein comprises a chitosanase, the chitosanase can comprise an endo-1,4-beta-d-glucosaminidase.

Where the fusion protein comprises a chitosanase, the chitosanase can comprise a *Streptomyces* chitosanase.

Where the fusion protein comprises a chitosanase, the chitosanase can comprise an amino acid sequence having at least 70% identity to SEQ ID NO: 280.

For example, the chitosanase can comprise an amino acid sequence having at least 75% identity to SEQ ID NO: 280.

The chitosanase can comprise an amino acid sequence having at least 80% identity to SEQ ID NO: 280.

The chitosanase can comprise an amino acid sequence having at least 85% identity to SEQ ID NO: 280.

The chitosanase can comprise an amino acid sequence having at least 90% identity to SEQ ID NO: 280.

The chitosanase can comprise an amino acid sequence having at least 95% identity to SEQ ID NO: 280.

The chitosanase can comprise an amino acid sequence having at least 98% identity to SEQ ID NO: 280.

The chitosanase can comprise an amino acid sequence having at least 99% identity to SEQ ID NO: 280.

The chitosanase can comprise an amino acid sequence having 100% identity to SEQ ID NO: 280.

Where the fusion protein comprises a chitosanase, the chitosanase can consist essentially of an amino acid sequence having at least 70% identity to SEQ ID NO: 279.

For example, the chitosanase can consist essentially of an amino acid sequence having at least 75% identity to SEQ ID NO: 279.

The chitosanase can consist essentially of an amino acid sequence having at least 80% identity to SEQ ID NO: 279.

The chitosanase can consist essentially of an amino acid sequence having at least 85% identity to SEQ ID NO: 279.

The chitosanase can consist essentially of an amino acid sequence having at least 90% identity to SEQ ID NO: 279.

The chitosanase can consist essentially of an amino acid sequence having at least 95% identity to SEQ ID NO: 279.

The chitosanase can consist essentially of an amino acid sequence having at least 98% identity to SEQ ID NO: 279.

The chitosanase can consist essentially of an amino acid sequence having at least 99% identity to SEQ ID NO: 279.

The chitosanase can consist essentially of an amino acid sequence having at least 100% identity to SEQ ID NO: 279.

Where the fusion protein comprises a chitosanase, the chitosanase can consist of an amino acid sequence having at least 70% identity to SEQ ID NO: 279.

For example, the chitosanase can consist of an amino acid sequence having at least 75% identity to SEQ ID NO: 279.

The chitosanase can consist of an amino acid sequence having at least 80% identity to SEQ ID NO: 279.

The chitosanase can consist of an amino acid sequence having at least 85% identity to SEQ ID NO: 279.

The chitosanase can consist of an amino acid sequence having at least 90% identity to SEQ ID NO: 279.

The chitosanase can consist of an amino acid sequence having at least 95% identity to SEQ ID NO: 279.

The chitosanase can consist of an amino acid sequence having at least 98% identity to SEQ ID NO: 279.

The chitosanase can consist of an amino acid sequence having at least 99% identity to SEQ ID NO: 279.

The chitosanase can consist of an amino acid sequence having at least 100% identity to SEQ ID NO: 279.

8. Fusion Proteins Comprising a Glucanase

Fusion proteins comprising a targeting sequence, exosporium protein, or exosporium protein fragment that targets the fusion protein to the exosporium of a recombinant *Bacillus cereus* family member and a glucanase are provided.

Where the fusion protein comprises a glucanase, the glucanase can comprise an alpha-1,6-glucanase.

Where the fusion protein comprises a glucanase, the glucanase can comprise a beta 1,3/1,4 glucanase.

Where the fusion protein comprises a glucanase, the glucanase can comprise a xyloglucan:xyloglucosyl transferase.

Where the fusion protein comprises a glucanase, the glucanase can comprise a cycloheptaglucanase.

Where the fusion protein comprises a glucanase, the glucanase can comprise an oligoxyloglucan beta-glycosidase.

Where the fusion protein comprises a glucanase, the glucanase can comprise a cyclohexaglucanase.

Where the fusion protein comprises a glucanase, the glucanase can comprise a xyloglucanase.

Where the fusion protein comprises a glucanase, the glucanase can comprise a cellulose 1,4-beta-cellobiosidase.

Where the fusion protein comprises a glucanase, the glucanase can comprise a glucan endo-1,3-beta-D-glucosidase.

Where the fusion protein comprises a glucanase, the glucanase can comprise a cyclomaltodextrinase.

Where the fusion protein comprises a glucanase, the glucanase can comprise a glucan 1,3-beta-glucosidase.

Where the fusion protein comprises a glucanase, the glucanase can comprise a glucan endo-1,3-alpha-glucosidase.

Where the fusion protein comprises a glucanase, the glucanase can comprise an endo-1,3(4)-beta-glucanase.

Where the fusion protein comprises a glucanase, the glucanase can comprise a lichenase.

Where the fusion protein comprises a glucanase, the glucanase can comprise a laminarinase.

Where the fusion protein comprises a glucanase, the glucanase can comprise a glucan 1,4-beta-glucosidase.

Where the fusion protein comprises a glucanase, the glucanase can comprise a glucan endo-1,6-beta-glucosidase.

Where the fusion protein comprises a glucanase, the glucanase can comprise a glucan 1,3-alpha-glucosidase.

Where the fusion protein comprises a glucanase, the glucanase can comprise an amylopectinase.

Where the fusion protein comprises a glucanase, the glucanase can comprise an amyloglucanase.

Where the fusion protein comprises a glucanase, the glucanase can comprise an amyloglucosidase.

Where the fusion protein comprises a glucanase, the glucanase can comprise an *Acidothermus* glucanase.

Where the fusion protein comprises a glucanase, the glucanase can comprise an *Aspergillus* glucanase.

Where the fusion protein comprises a glucanase, the glucanase can comprise a *Paenibacillus* glucanase.

Where the fusion protein comprises a glucanase, the glucanase can comprise a *Helix* glucanase.

Where the fusion protein comprises a glucanase, the glucanase can comprise a *Bacillus circulans* glucanase.

Where the fusion protein comprises a glucanase, the glucanase can comprise a *Bacillus lichenformis* glucanase.

Where the fusion protein comprises a glucanase, the glucanase can comprise a *Clostridium* glucanase.

Where the fusion protein comprises a glucanase, the glucanase can comprise a *Trichoderma reesei* beta-1,4-endoglucanase.

Where the fusion protein comprises a glucanase, the glucanase can comprise a *Bacillus subtilis* amylase.

For example, in any of the fusion proteins comprising a glucanase, the glucanase can comprise an *Acidothermus* glucanase, an *Aspergillus* glucanase, a *Paenibacillus* glucanase, a *Helix* glucanase, a *Bacillus lichenformis* glucanase, a *Clostridium* glucanase, a *Trichoderma reesei* beta-1,4-endoglucanase, a *Bacillus subtilis* amylase, or a combination of any thereof.

Where the glucanase comprises a *Helix* glucanase, the *Helix* glucanase can comprise a *Helix pomatia* glucanase (e.g., a *Helix pomatia* beta-1,3-endoglucanase).

Where the glucanase comprises an *Acidothermus* glucanase, the *Acidothermus* glucanase can comprise an *Acidothermus cellulolyticus* glucanase (e.g., an *Acidothermus cellulolyticus* beta-1,4 endoglucanase).

Where the glucanase comprises a *Clostridium* glucanase, the *Clostridium* glucanase can comprise a *Clostridium thermocellum* glucanase.

Where the fusion protein comprises a glucanase, the glucanase can comprise an amino acid sequence having at least 70% identity to any one of SEQ ID NOs. 281-292 and 295-302.

For example, the glucanase can comprise an amino acid sequence having at least 75% identity to any one of SEQ ID NOs. 281-292 and 295-302.

The glucanase can comprise an amino acid sequence having at least 80% identity to any one of SEQ ID NOs. 281-292 and 295-302.

The glucanase can comprise an amino acid sequence having at least 85% identity to any one of SEQ ID NOs. 281-292 and 295-302.

The glucanase can comprise an amino acid sequence having at least 90% identity to any one of SEQ ID NOs. 281-292 and 295-302.

The glucanase can comprise an amino acid sequence having at least 95% identity to any one of SEQ ID NOs. 281-292 and 295-302.

The glucanase can comprise an amino acid sequence having at least 98% identity to any one of SEQ ID NOs. 281-292 and 295-302.

The glucanase can comprise an amino acid sequence having at least 99% identity to any one of SEQ ID NOs. 281-292 and 295-302.

The glucanase can comprise an amino acid sequence having 100% identity to any one of SEQ ID NOs. 281-292 and 295-302.

Where the fusion protein comprises a glucanase, the glucanase can comprise an amino acid sequence having at least 70% identity to any one of SEQ ID NOs. 281-292, 295-296 and 298-302.

For example, the glucanase can comprise an amino acid sequence having at least 75% identity to any one of SEQ ID NOs. 281-292, 295-296 and 298-302.

The glucanase can comprise an amino acid sequence having at least 80% identity to any one of SEQ ID NOs. 281-292, 295-296 and 298-302.

The glucanase can comprise an amino acid sequence having at least 85% identity to any one of SEQ ID NOs. 281-292, 295-296 and 298-302.

The glucanase can comprise an amino acid sequence having at least 90% identity to any one of SEQ ID NOs. 281-292, 295-296 and 298-302.

The glucanase can comprise an amino acid sequence having at least 95% identity to any one of SEQ ID NOs. 281-292, 295-296 and 298-302.

The glucanase can comprise an amino acid sequence having at least 98% identity to any one of SEQ ID NOs. 281-292, 295-296 and 298-302.

The glucanase can comprise an amino acid sequence having at least 99% identity to any one of SEQ ID NOs. 281-292, 295-296 and 298-302.

The glucanase can comprise an amino acid sequence having 100% identity to any one of SEQ ID NOs. 281-292, 295-296 and 298-302.

Where the fusion protein comprises a glucanase, the glucanase can comprise an amino acid sequence having at least 70% identity to SEQ ID NO: 299 or 300.

For example, the glucanase can comprise an amino acid sequence having at least 75% identity to SEQ ID NO: 299 or 300.

The glucanase can comprise an amino acid sequence having at least 80% identity to SEQ ID NO: 299 or 300.

The glucanase can comprise an amino acid sequence having at least 85% identity to SEQ ID NO: 299 or 300.

The glucanase can comprise an amino acid sequence having at least 90% identity to SEQ ID NO: 299 or 300.

The glucanase can comprise an amino acid sequence having at least 95% identity to SEQ ID NO: 299 or 300.

The glucanase can comprise an amino acid sequence having at least 98% identity to SEQ ID NO: 299 or 300.

The glucanase can comprise an amino acid sequence having at least 99% identity to SEQ ID NO: 299 or 300.

The glucanase can comprise an amino acid sequence having 100% identity to SEQ ID NO: 299 or 300.

Where the fusion protein comprises a glucanase, the glucanase can consist essentially of an amino acid sequence having at least 70% identity to SEQ ID NO: 293 or 294.

For example, the glucanase can consist essentially of an amino acid sequence having at least 75% identity to SEQ ID NO: 293 or 294.

The glucanase can consist essentially of an amino acid sequence having at least 80% identity to SEQ ID NO: 293 or 294.

The glucanase can consist essentially of an amino acid sequence having at least 85% identity to SEQ ID NO: 293 or 294.

The glucanase can consist essentially of an amino acid sequence having at least 90% identity to SEQ ID NO: 293 or 294.

The glucanase can consist essentially of an amino acid sequence having at least 95% identity to SEQ ID NO: 293 or 294.

The glucanase can consist essentially of an amino acid sequence having at least 98% identity to SEQ ID NO: 293 or 294.

The glucanase can consist essentially of an amino acid sequence having at least 99% identity to SEQ ID NO: 293 or 294.

The glucanase can consist essentially of an amino acid sequence having 100% identity to SEQ ID NO: 293 or 294.

Where the fusion protein comprises a glucanase, the glucanase can consist of an amino acid sequence having at least 70% identity to SEQ ID NO: 293 or 294.

For example, the glucanase can consist of an amino acid sequence having at least 75% identity to SEQ ID NO: 293 or 294.

The glucanase can consist of an amino acid sequence having at least 80% identity to SEQ ID NO: 293 or 294.

The glucanase can consist of an amino acid sequence having at least 85% identity to SEQ ID NO: 293 or 294.

The glucanase can consist of an amino acid sequence having at least 90% identity to SEQ ID NO: 293 or 294.

The glucanase can consist of an amino acid sequence having at least 95% identity to SEQ ID NO: 293 or 294.

The glucanase can consist of an amino acid sequence having at least 98% identity to SEQ ID NO: 293 or 294.

The glucanase can consist of an amino acid sequence having at least 99% identity to SEQ ID NO: 293 or 294.

The glucanase can consist of an amino acid sequence having 100% identity to SEQ ID NO: 293 or 294.

Where the fusion protein comprises a glucanase, the glucanase suitably comprises a xyloglucanase.

Where the glucanase comprises a xyloglucanase, the xyloglucanase can comprise a xyloglucan-specific endo-beta-1,4-glucanase, a xyloglucan-specific exo-beta-1,4-glucanase, or a combination thereof.

Where the glucanase comprises a xyloglucanase, the xyloglucanase can comprise a *Paenibacillus* xyloglucanase (e.g., a *Paenibacillus pabuli* xyloglucanase) or a *Bacillus* xyloglucanase (e.g., a *Bacillus lichenformis* xyloglucanase).

Where the fusion protein comprises a glucanase, the glucanase suitably comprises a lichenase.

For example, where the glucanase comprises a lichenase, the lichenase can comprise a *Bacillus subtilis* lichenase or a *Clostridium thermocellum* lichenase.

Where the fusion protein comprises a glucanase, the glucanase suitably comprises a *Bacillus subtilis* amylase.

9. Fusion Proteins Comprising a Protease

Fusion proteins comprising a targeting sequence, exosporium protein, or exosporium protein fragment that targets the fusion protein to the exosporium of a recombinant *Bacillus cereus* family member and a protease are provided.

Where the fusion protein comprises a protease, the protease can comprise an asparagine protease.

Where the fusion protein comprises a protease, the protease can comprise a *Bacillus* protease.

For example, the protease can comprise a *Bacillus subtilis* protease.

Where the fusion protein comprises a protease, the protease can comprise an *Aspergillus* protease.

Where the fusion protein comprises a protease, the protease can comprise an amino acid sequence having at least 70% identity to any one of SEQ ID NOs. 303-306.

For example, the protease can comprise an amino acid sequence having at least 75% identity to any one of SEQ ID NOs. 303-306.

The protease can comprise an amino acid sequence having at least 80% identity to any one of SEQ ID NOs. 303-306.

The protease can comprise an amino acid sequence having at least 85% identity to any one of SEQ ID NOs. 303-306.

The protease can comprise an amino acid sequence having at least 90% identity to any one of SEQ ID NOs. 303-306.

The protease can comprise an amino acid sequence having at least 95% identity to any one of SEQ ID NOs. 303-306.

The protease can comprise an amino acid sequence having at least 98% identity to any one of SEQ ID NOs. 303-306.

The protease can comprise an amino acid sequence having at least 99% identity to any one of SEQ ID NOs. 303-306.

The protease can comprise an amino acid sequence having 100% identity to any one of SEQ ID NOs. 303-306.

Where the fusion protein comprises a protease, the protease can comprise an amino acid sequence having at least 70% identity to SEQ ID NO: 305 or 306.

For example, the protease can comprise an amino acid sequence having at least 75% identity to SEQ ID NO: 305 or 306.

The protease can comprise an amino acid sequence having at least 80% identity to SEQ ID NO: 305 or 306.

The protease can comprise an amino acid sequence having at least 85% identity to SEQ ID NO: 305 or 306.

The protease can comprise an amino acid sequence having at least 90% identity to SEQ ID NO: 305 or 306.

The protease can comprise an amino acid sequence having at least 95% identity to SEQ ID NO: 305 or 306.

The protease can comprise an amino acid sequence having at least 98% identity to SEQ ID NO: 305 or 306.

The protease can comprise an amino acid sequence having at least 99% identity to SEQ ID NO: 305 or 306.

The protease can comprise an amino acid sequence having 100% identity to SEQ ID NO: 305 or 306.

Where the fusion protein comprises a protease, the protease can comprise an amino acid sequence having 100% identity to SEQ ID NO: 304.

Where the fusion protein comprises a protease, the protease preferably does not consist of a methionine aminopeptidase.

Where the fusion protein comprises a protease, the protease preferably does not comprise a methionine aminopeptidase.

10. Fusion Proteins Comprising a Mannanase

Fusion proteins comprising a targeting sequence, exosporium protein, or exosporium protein fragment that targets the fusion protein to the exosporium of a recombinant *Bacillus cereus* family member and a mannanase are provided.

For example, where the fusion protein comprises a mannanase, the mannanase can comprise a *Bacillus* mannanase.

Where the fusion protein comprises a mannanase, the mannanase can comprise an amino acid sequence having at least 70% identity to SEQ ID NO: 307 or 308.

For example, the mannanase can comprise an amino acid sequence having at least 75% identity to SEQ ID NO: 307 or 308.

The mannanase can comprise an amino acid sequence having at least 80% identity to SEQ ID NO: 307 or 308.

The mannanase can comprise an amino acid sequence having at least 85% identity to SEQ ID NO: 307 or 308.

The mannanase can comprise an amino acid sequence having at least 90% identity to SEQ ID NO: 307 or 308.

The mannanase can comprise an amino acid sequence having at least 95% identity to SEQ ID NO: 307 or 308.

The mannanase can comprise an amino acid sequence having at least 98% identity to SEQ ID NO: 307 or 308.

The mannanase can comprise an amino acid sequence having at least 99% identity to SEQ ID NO: 307 or 308.

The mannanase can comprise an amino acid sequence having 100% identity to SEQ ID NO: 307 or 308.

11. Fusion Proteins Comprising a Pectinase

Fusion proteins comprising a targeting sequence, exosporium protein, or exosporium protein fragment that targets the fusion protein to the exosporium of a recombinant *Bacillus cereus* family member and a pectinase are provided.

Where the fusion protein comprises a pectinase, the pectinase comprises a pectolyase.

For example, the pectolyase can comprise an *Aspergillus* pectolyase or a *Bacillus* pectolyase.

Alternatively or in addition, the pectolyase can comprise an amino acid sequence having at least 70% identity to SEQ ID NO: 309 or 310.

For example, the pectolyase can comprise an amino acid sequence having at least 75% identity to SEQ ID NO: 309 or 310.

The pectolyase can comprise an amino acid sequence having at least 80% identity to SEQ ID NO: 309 or 310.

The pectolyase can comprise an amino acid sequence having at least 85% identity to SEQ ID NO: 309 or 310.

The pectolyase can comprise an amino acid sequence having at least 90% identity to SEQ ID NO: 309 or 310.

The pectolyase can comprise an amino acid sequence having at least 95% identity to SEQ ID NO: 309 or 310.

The pectolyase can comprise an amino acid sequence having at least 98% identity to SEQ ID NO: 309 or 310.

The pectolyase can comprise an amino acid sequence having at least 99% identity to SEQ ID NO: 309 or 310.

The pectolyase can comprise an amino acid sequence having 100% identity to SEQ ID NO: 309 or 310.

12. Fusion Proteins Comprising an Acid Phosphatase

Fusion proteins comprising a targeting sequence, exosporium protein, or exosporium protein fragment that targets the fusion protein to the exosporium of a recombinant *Bacillus cereus* family member and an acid phosphatase are provided.

Where the fusion protein comprises an acid phosphatase, the acid phosphatase can comprise a *Triticum* acid phosphatase. For example, the acid phosphatase can comprise a *Triticum aestivum* acid phosphatase.

Alternatively or in addition, where the fusion protein comprises an acid phosphatase, the acid phosphatase can comprise a *Bacillus* acid phosphatase. For example, the acid phosphatase can comprise a *Bacillus thuringiensis* acid phosphatase.

Alternatively or in addition, where the fusion protein comprises an acid phosphatase, the acid phosphatase can comprise an amino acid sequence having at least 70%, at least 75%, at least 80%, at least 85%, at least 90%, at least 95%, at least 98%, at least 99% identity, or 100% identity to any one of SEQ ID NOs: 311, 312, and 378.

For example, the acid phosphatase can comprise an amino acid sequence having at least 70% identity to SEQ ID NO: 311.

The acid phosphatase can comprise an amino acid sequence having at least 75% identity to SEQ ID NO: 311.

The acid phosphatase can comprise an amino acid sequence having at least 80% identity to SEQ ID NO: 311.

The acid phosphatase can comprise an amino acid sequence having at least 85% identity to SEQ ID NO: 311.

The acid phosphatase can comprise an amino acid sequence having at least 90% identity to SEQ ID NO: 311.

The acid phosphatase can comprise an amino acid sequence having at least 95% identity to SEQ ID NO: 311.

The acid phosphatase can comprise an amino acid sequence having at least 98% identity to SEQ ID NO: 311.

The acid phosphatase can comprise an amino acid sequence having at least 99% identity to SEQ ID NO: 311.

The acid phosphatase can comprise an amino acid sequence having 100% identity to SEQ ID NO: 311.

The acid phosphatase can comprise an amino acid sequence having at least 70% identity to SEQ ID NO: 312.

The acid phosphatase can comprise an amino acid sequence having at least 75% identity to SEQ ID NO: 312.

The acid phosphatase can comprise an amino acid sequence having at least 80% identity to SEQ ID NO: 312.

The acid phosphatase can comprise an amino acid sequence having at least 85% identity to SEQ ID NO: 312.

The acid phosphatase can comprise an amino acid sequence having at least 90% identity to SEQ ID NO: 312.

The acid phosphatase can comprise an amino acid sequence having at least 95% identity to SEQ ID NO: 312.

The acid phosphatase can comprise an amino acid sequence having at least 98% identity to SEQ ID NO: 312.

The acid phosphatase can comprise an amino acid sequence having at least 99% identity to SEQ ID NO: 312.

The acid phosphatase can comprise an amino acid sequence having 100% identity to SEQ ID NO: 312.

The acid phosphatase can comprise an amino acid sequence having at least 70% identity to SEQ ID NO: 378.

The acid phosphatase can comprise an amino acid sequence having at least 75% identity to SEQ ID NO: 378.

The acid phosphatase can comprise an amino acid sequence having at least 80% identity to SEQ ID NO: 378.

The acid phosphatase can comprise an amino acid sequence having at least 85% identity to SEQ ID NO: 378.

The acid phosphatase can comprise an amino acid sequence having at least 90% identity to SEQ ID NO: 378.

The acid phosphatase can comprise an amino acid sequence having at least 95% identity to SEQ ID NO: 378.

The acid phosphatase can comprise an amino acid sequence having at least 98% identity to SEQ ID NO: 378.

The acid phosphatase can comprise an amino acid sequence having at least 99% identity to SEQ ID NO: 378.

The acid phosphatase can comprise an amino acid sequence having 100% identity to SEQ ID NO: 378.

13. Fusion Proteins Comprising a Phytase

Fusion proteins comprising a targeting sequence, exosporium protein, or exosporium protein fragment that targets the fusion protein to the exosporium of a recombinant *Bacillus cereus* family member and a phytase are provided.

Where the fusion protein comprises a phytase, the phytase can comprise a *Triticum* phytase. For example, the phytase can comprise a *Triticum aestivum* phytase.

Alternatively, or in addition, the phytase can comprise a *Bacillus* phytase. For example, the phytase can comprise a *Bacillus thuringiensis* phytase.

Alternatively or in addition, the phytase can comprise an amino acid sequence having at least 70% identity to any one of SEQ ID NOs. 313-315 and 380.

For example, the phytase can comprise an amino acid sequence having at least 75% identity to any one of SEQ ID NOs. 313-315 and 380.

The phytase can comprise an amino acid sequence having at least 80% identity to any one of SEQ ID NOs. 313-315 and 380.

The phytase can comprise an amino acid sequence having at least 85% identity to any one of SEQ ID NOs. 313-315 and 380.

The phytase can comprise an amino acid sequence having at least 90% identity to any one of SEQ ID NOs. 313-315 and 380.

The phytase can comprise an amino acid sequence having at least 95% identity to any one of SEQ ID NOs. 313-315 and 380.

The phytase can comprise an amino acid sequence having at least 98% identity to any one of SEQ ID NOs. 313-315 and 380.

The phytase can comprise an amino acid sequence having at least 99% identity to any one of SEQ ID NOs. 313-315 and 380.

The phytase can comprise an amino acid sequence having 100% identity to any one of SEQ ID NOs. 313-315 and 380.

Alternatively or in addition, the phytase can comprise an amino acid sequence having at least 70% identity to SEQ ID NO. 380.

For example, the phytase can comprise an amino acid sequence having at least 75% identity to SEQ ID NO. 380.

The phytase can comprise an amino acid sequence having at least 80% identity to SEQ ID NO. 380.

The phytase can comprise an amino acid sequence having at least 85% identity to SEQ ID NO. 380.

The phytase can comprise an amino acid sequence having at least 90% identity to SEQ ID NO. 380.

The phytase can comprise an amino acid sequence having at least 95% identity to SEQ ID NO. 380.

The phytase can comprise an amino acid sequence having at least 98% identity to SEQ ID NO. 380.

The phytase can comprise an amino acid sequence having at least 99% identity to SEQ ID NO. 380.

The phytase can comprise an amino acid sequence having 100% identity to SEQ ID NO. 380.

14. Fusion Proteins Comprising an Expansin Protein

Fusion proteins comprising a targeting sequence, exosporium protein, or exosporium protein fragment that targets the fusion protein to the exosporium of a recombinant *Bacillus cereus* family member and an expansin protein are provided.

Where the fusion protein comprises an expansin protein, the expansin protein can comprise an amino acid sequence having at least 70% identity to SEQ ID NO: 316.

For example, the expansin can comprise an amino acid sequence having at least 75% identity to SEQ ID NO: 316.

The expansin can comprise an amino acid sequence having at least 80% identity to SEQ ID NO: 316.

The expansin can comprise an amino acid sequence having at least 85% identity to SEQ ID NO: 316.

The expansin can comprise an amino acid sequence having at least 90% identity to SEQ ID NO: 316.

The expansin can comprise an amino acid sequence having at least 95% identity to SEQ ID NO: 316.

The expansin can comprise an amino acid sequence having at least 98% identity to SEQ ID NO: 316.

The expansin can comprise an amino acid sequence having at least 99% identity to SEQ ID NO: 316.

The expansin can comprise an amino acid sequence having 100% identity to SEQ ID NO: 316.

15. Optional Inclusion of Signal Peptides in the Fusion Proteins

In any of the fusion proteins described herein, any of the signal peptides described herein can be present.

Where the signal peptide is present, it is preferably present at the amino terminus of the enzyme having ACC deaminase activity, the phospholipase, the lipase, the xylanase, the xylosidase, the lactonase, the chitosanase, the protease, the glucanase, the phytase, the acid phosphatase, the pectinase, the mannanase, or the expansin protein.

The signal peptide preferably immediately precedes the first amino acid of the enzyme having ACC deaminase activity, the phospholipase, the lipase, the xylanase, the xylosidase, the lactonase, the chitosanase, the protease, the glucanase, the phytase, the acid phosphatase, the pectinase, the mannanase, or the expansin protein.

Thus, for example, a fusion protein comprising the targeting sequence of SEQ ID NO: 96 and the lichenase of SEQ ID NO: 295 can have the following structures, shown with and without the signal sequence (e.g., the signal sequence of SEQ ID NO: 335):

Without signal sequence: SEQ ID NO: 96-SEQ ID NO: 295

With signal sequence: SEQ ID NO: 96-SEQ ID NO: 335-SEQ ID NO: 295

Thus, in any of the fusion proteins described herein, the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase can further comprise a signal peptide.

Where the fusion protein comprises a signal peptide, the signal peptide can be present at the amino terminus of the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

In any of the fusion proteins described herein comprising a signal peptide, the signal peptide can comprise an amino acid sequence having at least 70% identity with any one of SEQ ID NOs. 317-360 and 376-379.

For example, the signal peptide can comprise an amino acid sequence having at least 75% identity with any one of SEQ ID NOs. 317-360 and 376-379.

The signal peptide can comprise an amino acid sequence having at least 80% identity with any one of SEQ ID NOs. 317-360 and 376-379.

The signal peptide can comprise an amino acid sequence having at least 85% identity with any one of SEQ ID NOs. 317-360 and 376-379.

The signal peptide can comprise an amino acid sequence having at least 90% identity with any one of SEQ ID NOs. 317-360 and 376-379.

The signal peptide can comprise an amino acid sequence having at least 95% identity with any one of SEQ ID NOs. 317-360 and 376-379.

The signal peptide can comprise an amino acid sequence having at least 98% identity with any one of SEQ ID NOs. 317-360 and 376-379.

The signal peptide can comprise an amino acid sequence having at least 99% identity with any one of SEQ ID NOs. 317-360 and 376-379.

The signal peptide can comprise an amino acid sequence having 100% identity with any one of SEQ ID NOs. 317-360 and 376-379.

Where the fusion protein comprises a signal peptide, the fusion protein can comprise a phospholipase comprising an amino acid sequence having at least 70% identity to SEQ ID NO: 252. The phospholipase further comprises a signal peptide comprising SEQ ID NO: 317 at its amino terminus.

The fusion protein can comprise a phospholipase comprising an amino acid sequence having at least 75% identity to SEQ ID NO: 252. The phospholipase further comprises a signal peptide comprising SEQ ID NO: 317 at its amino terminus.

The fusion protein can comprise a phospholipase comprising an amino acid sequence having at least 80% identity to SEQ ID NO: 252. The phospholipase further comprises a signal peptide comprising SEQ ID NO: 317 at its amino terminus.

The fusion protein can comprise a phospholipase comprising an amino acid sequence having at least 85% identity to SEQ ID NO: 252. The phospholipase further comprises a signal peptide comprising SEQ ID NO: 317 at its amino terminus.

The fusion protein can comprise a phospholipase comprising an amino acid sequence having at least 90% identity to SEQ ID NO: 252. The phospholipase further comprises a signal peptide comprising SEQ ID NO: 317 at its amino terminus.

The fusion protein can comprise a phospholipase comprising an amino acid sequence having at least 95% identity to SEQ ID NO: 252. The phospholipase further comprises a signal peptide comprising SEQ ID NO: 317 at its amino terminus.

The fusion protein can comprise a phospholipase comprising an amino acid sequence having at least 98% identity to SEQ ID NO: 252. The phospholipase further comprises a signal peptide comprising SEQ ID NO: 317 at its amino terminus.

The fusion protein can comprise a phospholipase comprising an amino acid sequence having at least 99% identity to SEQ ID NO: 252. The phospholipase further comprises a signal peptide comprising SEQ ID NO: 317 at its amino terminus.

The fusion protein can comprise a phospholipase comprising an amino acid sequence having 100% identity to SEQ ID NO: 252. The phospholipase further comprises a signal peptide comprising SEQ ID NO: 317 at its amino terminus.

Where the fusion protein comprises a signal peptide, the fusion protein can comprise a phospholipase comprising an amino acid sequence having at least 70% identity to SEQ ID NO: 253. The phospholipase further comprises a signal peptide comprising SEQ ID NO: 318 at its amino terminus.

The fusion protein can comprise a phospholipase comprising an amino acid sequence having at least 75% identity to SEQ ID NO: 253. The phospholipase further comprises a signal peptide comprising SEQ ID NO: 318 at its amino terminus.

The fusion protein can comprise a phospholipase comprising an amino acid sequence having at least 80% identity to SEQ ID NO: 253. The phospholipase further comprises a signal peptide comprising SEQ ID NO: 318 at its amino terminus.

The fusion protein can comprise a phospholipase comprising an amino acid sequence having at least 85% identity to SEQ ID NO: 253. The phospholipase further comprises a signal peptide comprising SEQ ID NO: 318 at its amino terminus.

The fusion protein can comprise a phospholipase comprising an amino acid sequence having at least 90% identity to SEQ ID NO: 253. The phospholipase further comprises a signal peptide comprising SEQ ID NO: 318 at its amino terminus.

The fusion protein can comprise a phospholipase comprising an amino acid sequence having at least 95% identity to SEQ ID NO: 253. The phospholipase further comprises a signal peptide comprising SEQ ID NO: 318 at its amino terminus.

The fusion protein can comprise a phospholipase comprising an amino acid sequence having at least 98% identity to SEQ ID NO: 253. The phospholipase further comprises a signal peptide comprising SEQ ID NO: 318 at its amino terminus.

The fusion protein can comprise a phospholipase comprising an amino acid sequence having at least 99% identity to SEQ ID NO: 253. The phospholipase further comprises a signal peptide comprising SEQ ID NO: 318 at its amino terminus.

The fusion protein can comprise a phospholipase comprising an amino acid sequence having 100% identity to SEQ ID NO: 253. The phospholipase further comprises a signal peptide comprising SEQ ID NO: 318 at its amino terminus.

Where the fusion protein comprises a signal peptide, the fusion protein can comprise a phospholipase comprising an amino acid sequence having at least 70% identity to SEQ ID NO: 254. The phospholipase further comprises a signal peptide comprising SEQ ID NO: 319 at its amino terminus.

The fusion protein can comprise a phospholipase comprising an amino acid sequence having at least 75% identity to SEQ ID NO: 254. The phospholipase further comprises a signal peptide comprising SEQ ID NO: 319 at its amino terminus.

The fusion protein can comprise a phospholipase comprising an amino acid sequence having at least 80% identity to SEQ ID NO: 254. The phospholipase further comprises a signal peptide comprising SEQ ID NO: 319 at its amino terminus.

The fusion protein can comprise a phospholipase comprising an amino acid sequence having at least 85% identity to SEQ ID NO: 254. The phospholipase further comprises a signal peptide comprising SEQ ID NO: 319 at its amino terminus.

The fusion protein can comprise a phospholipase comprising an amino acid sequence having at least 90% identity to SEQ ID NO: 254. The phospholipase further comprises a signal peptide comprising SEQ ID NO: 319 at its amino terminus.

The fusion protein can comprise a phospholipase comprising an amino acid sequence having at least 95% identity to SEQ ID NO: 254. The phospholipase further comprises a signal peptide comprising SEQ ID NO: 319 at its amino terminus.

The fusion protein can comprise a phospholipase comprising an amino acid sequence having at least 98% identity to SEQ ID NO: 254. The phospholipase further comprises a signal peptide comprising SEQ ID NO: 319 at its amino terminus.

The fusion protein can comprise a phospholipase comprising an amino acid sequence having at least 99% identity to SEQ ID NO: 254. The phospholipase further comprises a signal peptide comprising SEQ ID NO: 319 at its amino terminus.

The fusion protein can comprise a phospholipase comprising an amino acid sequence having 100% identity to SEQ ID NO: 254. The phospholipase further comprises a signal peptide comprising SEQ ID NO: 319 at its amino terminus.

Where the fusion protein comprises a signal peptide, the fusion protein can comprise a phospholipase comprising an amino acid sequence having at least 70% identity to SEQ ID NO: 255. The phospholipase further comprises a signal peptide comprising SEQ ID NO: 320 at its amino terminus.

The fusion protein can comprise a phospholipase comprising an amino acid sequence having at least 75% identity to SEQ ID NO: 255. The phospholipase further comprises a signal peptide comprising SEQ ID NO: 320 at its amino terminus.

The fusion protein can comprise a phospholipase comprising an amino acid sequence having at least 80% identity to SEQ ID NO: 255. The phospholipase further comprises a signal peptide comprising SEQ ID NO: 320 at its amino terminus.

The fusion protein can comprise a phospholipase comprising an amino acid sequence having at least 85% identity to SEQ ID NO: 255. The phospholipase further comprises a signal peptide comprising SEQ ID NO: 320 at its amino terminus.

The fusion protein can comprise a phospholipase comprising an amino acid sequence having at least 90% identity to SEQ ID NO: 255. The phospholipase further comprises a signal peptide comprising SEQ ID NO: 320 at its amino terminus.

The fusion protein can comprise a phospholipase comprising an amino acid sequence having at least 95% identity to SEQ ID NO: 255. The phospholipase further comprises a signal peptide comprising SEQ ID NO: 320 at its amino terminus.

The fusion protein can comprise a phospholipase comprising an amino acid sequence having at least 98% identity to SEQ ID NO: 255. The phospholipase further comprises a signal peptide comprising SEQ ID NO: 320 at its amino terminus.

The fusion protein can comprise a phospholipase comprising an amino acid sequence having at least 99% identity to SEQ ID NO: 255. The phospholipase further comprises a signal peptide comprising SEQ ID NO: 320 at its amino terminus.

The fusion protein can comprise a phospholipase comprising an amino acid sequence having 100% identity to SEQ ID NO: 255. The phospholipase further comprises a signal peptide comprising SEQ ID NO: 320 at its amino terminus.

Where the fusion protein comprises a signal peptide, the fusion protein can comprise a phospholipase comprising an amino acid sequence having at least 70% identity to SEQ ID NO: 256. The phospholipase further comprises a signal peptide comprising SEQ ID NO: 321 at its amino terminus.

The fusion protein can comprise a phospholipase comprising an amino acid sequence having at least 75% identity to SEQ ID NO: 256. The phospholipase further comprises a signal peptide comprising SEQ ID NO: 321 at its amino terminus.

The fusion protein can comprise a phospholipase comprising an amino acid sequence having at least 80% identity to SEQ ID NO: 256. The phospholipase further comprises a signal peptide comprising SEQ ID NO: 321 at its amino terminus.

The fusion protein can comprise a phospholipase comprising an amino acid sequence having at least 85% identity to SEQ ID NO: 256. The phospholipase further comprises a signal peptide comprising SEQ ID NO: 321 at its amino terminus.

The fusion protein can comprise a phospholipase comprising an amino acid sequence having at least 90% identity to SEQ ID NO: 256. The phospholipase further comprises a signal peptide comprising SEQ ID NO: 321 at its amino terminus.

The fusion protein can comprise a phospholipase comprising an amino acid sequence having at least 95% identity to SEQ ID NO: 256. The phospholipase further comprises a signal peptide comprising SEQ ID NO: 321 at its amino terminus.

The fusion protein can comprise a phospholipase comprising an amino acid sequence having at least 98% identity to SEQ ID NO: 256. The phospholipase further comprises a signal peptide comprising SEQ ID NO: 321 at its amino terminus.

The fusion protein can comprise a phospholipase comprising an amino acid sequence having at least 99% identity to SEQ ID NO: 256. The phospholipase further comprises a signal peptide comprising SEQ ID NO: 321 at its amino terminus.

The fusion protein can comprise a phospholipase comprising an amino acid sequence having 100% identity to SEQ ID NO: 256. The phospholipase further comprises a signal peptide comprising SEQ ID NO: 321 at its amino terminus.

Where the fusion protein comprises a signal peptide, the fusion protein can comprise a phospholipase comprising an amino acid sequence having at least 70% identity to SEQ ID NO: 256. The phospholipase further comprises a signal peptide comprising SEQ ID NO: 322 at its amino terminus.

The fusion protein can comprise a phospholipase comprising an amino acid sequence having at least 75% identity to SEQ ID NO: 256. The phospholipase further comprises a signal peptide comprising SEQ ID NO: 322 at its amino terminus.

The fusion protein can comprise a phospholipase comprising an amino acid sequence having at least 80% identity to SEQ ID NO: 256. The phospholipase further comprises a signal peptide comprising SEQ ID NO: 322 at its amino terminus.

The fusion protein can comprise a phospholipase comprising an amino acid sequence having at least 85% identity to SEQ ID NO: 256. The phospholipase further comprises a signal peptide comprising SEQ ID NO: 322 at its amino terminus.

The fusion protein can comprise a phospholipase comprising an amino acid sequence having at least 90% identity to SEQ ID NO: 256. The phospholipase further comprises a signal peptide comprising SEQ ID NO: 322 at its amino terminus.

The fusion protein can comprise a phospholipase comprising an amino acid sequence having at least 95% identity to SEQ ID NO: 256. The phospholipase further comprises a signal peptide comprising SEQ ID NO: 322 at its amino terminus.

The fusion protein can comprise a phospholipase comprising an amino acid sequence having at least 98% identity to SEQ ID NO: 256. The phospholipase further comprises a signal peptide comprising SEQ ID NO: 322 at its amino terminus.

The fusion protein can comprise a phospholipase comprising an amino acid sequence having at least 99% identity to SEQ ID NO: 256. The phospholipase further comprises a signal peptide comprising SEQ ID NO: 322 at its amino terminus.

The fusion protein can comprise a phospholipase comprising an amino acid sequence having 100% identity to SEQ ID NO: 256. The phospholipase further comprises a signal peptide comprising SEQ ID NO: 322 at its amino terminus.

Where the fusion protein comprises a signal peptide, the fusion protein can comprise a phospholipase comprising an amino acid sequence having at least 70% identity to SEQ ID NO: 257. The phospholipase further comprises a signal peptide comprising SEQ ID NO: 323 at its amino terminus.

The fusion protein can comprise a phospholipase comprising an amino acid sequence having at least 75% identity to SEQ ID NO: 257. The phospholipase further comprises a signal peptide comprising SEQ ID NO: 323 at its amino terminus.

The fusion protein can comprise a phospholipase comprising an amino acid sequence having at least 80% identity to SEQ ID NO: 257. The phospholipase further comprises a signal peptide comprising SEQ ID NO: 323 at its amino terminus.

The fusion protein can comprise a phospholipase comprising an amino acid sequence having at least 85% identity to SEQ ID NO: 257. The phospholipase further comprises a signal peptide comprising SEQ ID NO: 323 at its amino terminus.

The fusion protein can comprise a phospholipase comprising an amino acid sequence having at least 90% identity to SEQ ID NO: 257. The phospholipase further comprises a signal peptide comprising SEQ ID NO: 323 at its amino terminus.

The fusion protein can comprise a phospholipase comprising an amino acid sequence having at least 95% identity to SEQ ID NO: 257. The phospholipase further comprises a signal peptide comprising SEQ ID NO: 323 at its amino terminus.

The fusion protein can comprise a phospholipase comprising an amino acid sequence having at least 98% identity to SEQ ID NO: 257. The phospholipase further comprises a signal peptide comprising SEQ ID NO: 323 at its amino terminus.

The fusion protein can comprise a phospholipase comprising an amino acid sequence having at least 99% identity to SEQ ID NO: 257. The phospholipase further comprises a signal peptide comprising SEQ ID NO: 323 at its amino terminus.

The fusion protein can comprise a phospholipase comprising an amino acid sequence having 100% identity to SEQ ID NO: 257. The phospholipase further comprises a signal peptide comprising SEQ ID NO: 323 at its amino terminus.

Where the fusion protein comprises a signal peptide, the fusion protein can comprise a phospholipase comprising an amino acid sequence having at least 70% identity to SEQ ID NO: 373. The phospholipase further comprises a signal peptide comprising SEQ ID NO: 376 at its amino terminus.

The fusion protein can comprise a phospholipase comprising an amino acid sequence having at least 75% identity to SEQ ID NO: 373. The phospholipase further comprises a signal peptide comprising SEQ ID NO: 376 at its amino terminus.

The fusion protein can comprise a phospholipase comprising an amino acid sequence having at least 80% identity to SEQ ID NO: 373. The phospholipase further comprises a signal peptide comprising SEQ ID NO: 376 at its amino terminus.

The fusion protein can comprise a phospholipase comprising an amino acid sequence having at least 85% identity to SEQ ID NO: 373. The phospholipase further comprises a signal peptide comprising SEQ ID NO: 376 at its amino terminus.

The fusion protein can comprise a phospholipase comprising an amino acid sequence having at least 90% identity to SEQ ID NO: 373. The phospholipase further comprises a signal peptide comprising SEQ ID NO: 376 at its amino terminus.

The fusion protein can comprise a phospholipase comprising an amino acid sequence having at least 95% identity to SEQ ID NO: 373. The phospholipase further comprises a signal peptide comprising SEQ ID NO: 376 at its amino terminus.

The fusion protein can comprise a phospholipase comprising an amino acid sequence having at least 98% identity to SEQ ID NO: 373. The phospholipase further comprises a signal peptide comprising SEQ ID NO: 376 at its amino terminus.

The fusion protein can comprise a phospholipase comprising an amino acid sequence having at least 99% identity to SEQ ID NO: 373. The phospholipase further comprises a signal peptide comprising SEQ ID NO: 376 at its amino terminus.

The fusion protein can comprise a phospholipase comprising an amino acid sequence having 100% identity to SEQ ID NO: 373. The phospholipase further comprises a signal peptide comprising SEQ ID NO: 376 at its amino terminus.

Where the fusion protein comprises a signal peptide, the fusion protein can comprise a phospholipase comprising an amino acid sequence having at least 70% identity to SEQ ID NO: 375. The phospholipase further comprises a signal peptide comprising SEQ ID NO: 377 at its amino terminus.

The fusion protein can comprise a phospholipase comprising an amino acid sequence having at least 75% identity to SEQ ID NO: 375. The phospholipase further comprises a signal peptide comprising SEQ ID NO: 377 at its amino terminus.

The fusion protein can comprise a phospholipase comprising an amino acid sequence having at least 80% identity to SEQ ID NO: 375. The phospholipase further comprises a signal peptide comprising SEQ ID NO: 377 at its amino terminus.

The fusion protein can comprise a phospholipase comprising an amino acid sequence having at least 85% identity to SEQ ID NO: 375. The phospholipase further comprises a signal peptide comprising SEQ ID NO: 377 at its amino terminus.

The fusion protein can comprise a phospholipase comprising an amino acid sequence having at least 90% identity to SEQ ID NO: 375. The phospholipase further comprises a signal peptide comprising SEQ ID NO: 377 at its amino terminus.

The fusion protein can comprise a phospholipase comprising an amino acid sequence having at least 95% identity to SEQ ID NO: 375. The phospholipase further comprises a signal peptide comprising SEQ ID NO: 377 at its amino terminus.

The fusion protein can comprise a phospholipase comprising an amino acid sequence having at least 98% identity to SEQ ID NO: 375. The phospholipase further comprises a signal peptide comprising SEQ ID NO: 377 at its amino terminus.

The fusion protein can comprise a phospholipase comprising an amino acid sequence having at least 99% identity to SEQ ID NO: 375. The phospholipase further comprises a signal peptide comprising SEQ ID NO: 377 at its amino terminus.

The fusion protein can comprise a phospholipase comprising an amino acid sequence having 100% identity to SEQ ID NO: 375. The phospholipase further comprises a signal peptide comprising SEQ ID NO: 377 at its amino terminus.

Where the fusion protein comprises a signal peptide, the fusion protein can comprise a lipase comprising an amino acid sequence having at least 70% identity to SEQ ID NO: 263. The lipase further comprises a signal peptide comprising SEQ ID NO: 324 at its amino terminus.

The fusion protein can comprise a lipase comprising an amino acid sequence having at least 75% identity to SEQ ID NO: 263. The lipase further comprises a signal peptide comprising SEQ ID NO: 324 at its amino terminus.

The fusion protein can comprise a lipase comprising an amino acid sequence having at least 80% identity to SEQ ID NO: 263. The lipase further comprises a signal peptide comprising SEQ ID NO: 324 at its amino terminus.

The fusion protein can comprise a lipase comprising an amino acid sequence having at least 85% identity to SEQ ID NO: 263. The lipase further comprises a signal peptide comprising SEQ ID NO: 324 at its amino terminus.

The fusion protein can comprise a lipase comprising an amino acid sequence having at least 90% identity to SEQ ID NO: 263. The lipase further comprises a signal peptide comprising SEQ ID NO: 324 at its amino terminus.

The fusion protein can comprise a lipase comprising an amino acid sequence having at least 95% identity to SEQ ID NO: 263. The lipase further comprises a signal peptide comprising SEQ ID NO: 324 at its amino terminus.

The fusion protein can comprise a lipase comprising an amino acid sequence having at least 98% identity to SEQ ID NO: 263. The lipase further comprises a signal peptide comprising SEQ ID NO: 324 at its amino terminus.

The fusion protein can comprise a lipase comprising an amino acid sequence having at least 99% identity to SEQ ID NO: 263. The lipase further comprises a signal peptide comprising SEQ ID NO: 324 at its amino terminus.

The fusion protein can comprise a lipase comprising an amino acid sequence having 100% identity to SEQ ID NO: 263. The lipase further comprises a signal peptide comprising SEQ ID NO: 324 at its amino terminus.

Where the fusion protein comprises a signal peptide, the fusion protein can comprise a lipase comprising an amino acid sequence having at least 70% identity to SEQ ID NO: 264. The lipase further comprises a signal peptide comprising SEQ ID NO: 325 at its amino terminus.

The fusion protein can comprise a lipase comprising an amino acid sequence having at least 75% identity to SEQ ID NO: 264. The lipase further comprises a signal peptide comprising SEQ ID NO: 325 at its amino terminus.

The fusion protein can comprise a lipase comprising an amino acid sequence having at least 80% identity to SEQ ID NO: 264. The lipase further comprises a signal peptide comprising SEQ ID NO: 325 at its amino terminus.

The fusion protein can comprise a lipase comprising an amino acid sequence having at least 85% identity to SEQ ID NO: 264. The lipase further comprises a signal peptide comprising SEQ ID NO: 325 at its amino terminus.

The fusion protein can comprise a lipase comprising an amino acid sequence having at least 90% identity to SEQ ID NO: 264. The lipase further comprises a signal peptide comprising SEQ ID NO: 325 at its amino terminus.

The fusion protein can comprise a lipase comprising an amino acid sequence having at least 95% identity to SEQ ID NO: 264. The lipase further comprises a signal peptide comprising SEQ ID NO: 325 at its amino terminus.

The fusion protein can comprise a lipase comprising an amino acid sequence having at least 98% identity to SEQ ID NO: 264. The lipase further comprises a signal peptide comprising SEQ ID NO: 325 at its amino terminus.

The fusion protein can comprise a lipase comprising an amino acid sequence having at least 99% identity to SEQ ID NO: 264. The lipase further comprises a signal peptide comprising SEQ ID NO: 325 at its amino terminus.

The fusion protein can comprise a lipase comprising an amino acid sequence having 100% identity to SEQ ID NO: 264. The lipase further comprises a signal peptide comprising SEQ ID NO: 325 at its amino terminus.

Where the fusion protein comprises a signal peptide, the fusion protein can comprise a lipase comprising an amino acid sequence having at least 70% identity to SEQ ID NO: 265. The lipase further comprises a signal peptide comprising SEQ ID NO: 326 at its amino terminus.

The fusion protein can comprise a lipase comprising an amino acid sequence having at least 75% identity to SEQ ID NO: 265. The lipase further comprises a signal peptide comprising SEQ ID NO: 326 at its amino terminus.

The fusion protein can comprise a lipase comprising an amino acid sequence having at least 80% identity to SEQ ID NO: 265. The lipase further comprises a signal peptide comprising SEQ ID NO: 326 at its amino terminus.

The fusion protein can comprise a lipase comprising an amino acid sequence having at least 85% identity to SEQ ID NO: 265. The lipase further comprises a signal peptide comprising SEQ ID NO: 326 at its amino terminus.

The fusion protein can comprise a lipase comprising an amino acid sequence having at least 90% identity to SEQ ID NO: 265. The lipase further comprises a signal peptide comprising SEQ ID NO: 326 at its amino terminus.

The fusion protein can comprise a lipase comprising an amino acid sequence having at least 95% identity to SEQ ID NO: 265. The lipase further comprises a signal peptide comprising SEQ ID NO: 326 at its amino terminus.

The fusion protein can comprise a lipase comprising an amino acid sequence having at least 98% identity to SEQ ID NO: 265. The lipase further comprises a signal peptide comprising SEQ ID NO: 326 at its amino terminus.

The fusion protein can comprise a lipase comprising an amino acid sequence having at least 99% identity to SEQ ID NO: 265. The lipase further comprises a signal peptide comprising SEQ ID NO: 326 at its amino terminus.

The fusion protein can comprise a lipase comprising an amino acid sequence having 100% identity to SEQ ID NO: 265. The lipase further comprises a signal peptide comprising SEQ ID NO: 326 at its amino terminus.

Where the fusion protein comprises a signal peptide, the fusion protein can comprise a xylanase comprising an amino acid sequence having at least 70% identity to SEQ ID NO: 267. The xylanase further comprises a signal peptide comprising SEQ ID NO: 327 at its amino terminus.

The fusion protein can comprise a xylanase comprising an amino acid sequence having at least 75% identity to SEQ ID NO: 267. The xylanase further comprises a signal peptide comprising SEQ ID NO: 327 at its amino terminus.

The fusion protein can comprise a xylanase comprising an amino acid sequence having at least 80% identity to SEQ ID NO: 267. The xylanase further comprises a signal peptide comprising SEQ ID NO: 327 at its amino terminus.

The fusion protein can comprise a xylanase comprising an amino acid sequence having at least 85% identity to SEQ ID NO: 267. The xylanase further comprises a signal peptide comprising SEQ ID NO: 327 at its amino terminus.

The fusion protein can comprise a xylanase comprising an amino acid sequence having at least 90% identity to SEQ ID NO: 267. The xylanase further comprises a signal peptide comprising SEQ ID NO: 327 at its amino terminus.

The fusion protein can comprise a xylanase comprising an amino acid sequence having at least 95% identity to SEQ ID NO: 267. The xylanase further comprises a signal peptide comprising SEQ ID NO: 327 at its amino terminus.

The fusion protein can comprise a xylanase comprising an amino acid sequence having at least 98% identity to SEQ ID NO: 267. The xylanase further comprises a signal peptide comprising SEQ ID NO: 327 at its amino terminus.

The fusion protein can comprise a xylanase comprising an amino acid sequence having at least 99% identity to SEQ ID NO: 267. The xylanase further comprises a signal peptide comprising SEQ ID NO: 327 at its amino terminus.

The fusion protein can comprise a xylanase comprising an amino acid sequence having at least 100% identity to SEQ ID NO: 267. The xylanase further comprises a signal peptide comprising SEQ ID NO: 327 at its amino terminus.

Where the fusion protein comprises a signal peptide, the fusion protein can comprise a xylanase comprising an amino acid sequence having at least 70% identity to SEQ ID NO: 268. The xylanase further comprises a signal peptide comprising SEQ ID NO: 328 at its amino terminus.

The fusion protein can comprise a xylanase comprising an amino acid sequence having at least 75% identity to SEQ ID NO: 268. The xylanase further comprises a signal peptide comprising SEQ ID NO: 328 at its amino terminus.

The fusion protein can comprise a xylanase comprising an amino acid sequence having at least 80% identity to SEQ ID NO: 268. The xylanase further comprises a signal peptide comprising SEQ ID NO: 328 at its amino terminus.

The fusion protein can comprise a xylanase comprising an amino acid sequence having at least 85% identity to SEQ ID NO: 268. The xylanase further comprises a signal peptide comprising SEQ ID NO: 328 at its amino terminus.

The fusion protein can comprise a xylanase comprising an amino acid sequence having at least 90% identity to SEQ ID NO: 268. The xylanase further comprises a signal peptide comprising SEQ ID NO: 328 at its amino terminus.

The fusion protein can comprise a xylanase comprising an amino acid sequence having at least 95% identity to SEQ ID NO: 268. The xylanase further comprises a signal peptide comprising SEQ ID NO: 328 at its amino terminus.

The fusion protein can comprise a xylanase comprising an amino acid sequence having at least 98% identity to SEQ ID NO: 268. The xylanase further comprises a signal peptide comprising SEQ ID NO: 328 at its amino terminus.

The fusion protein can comprise a xylanase comprising an amino acid sequence having at least 99% identity to SEQ ID NO: 268. The xylanase further comprises a signal peptide comprising SEQ ID NO: 328 at its amino terminus.

The fusion protein can comprise a xylanase comprising an amino acid sequence having 100% identity to SEQ ID NO: 268. The xylanase further comprises a signal peptide comprising SEQ ID NO: 328 at its amino terminus.

Where the fusion protein comprises a signal peptide, the fusion protein can comprise a xylanase comprising an amino acid sequence having at least 70% identity to SEQ ID NO: 269. The xylanase further comprises a signal peptide comprising SEQ ID NO: 329 at its amino terminus.

The fusion protein can comprise a xylanase comprising an amino acid sequence having at least 75% identity to SEQ ID NO: 269. The xylanase further comprises a signal peptide comprising SEQ ID NO: 329 at its amino terminus.

The fusion protein can comprise a xylanase comprising an amino acid sequence having at least 80% identity to SEQ ID NO: 269. The xylanase further comprises a signal peptide comprising SEQ ID NO: 329 at its amino terminus.

The fusion protein can comprise a xylanase comprising an amino acid sequence having at least 85% identity to SEQ ID NO: 269. The xylanase further comprises a signal peptide comprising SEQ ID NO: 329 at its amino terminus.

The fusion protein can comprise a xylanase comprising an amino acid sequence having at least 90% identity to SEQ ID NO: 269. The xylanase further comprises a signal peptide comprising SEQ ID NO: 329 at its amino terminus.

The fusion protein can comprise a xylanase comprising an amino acid sequence having at least 95% identity to SEQ ID NO: 269. The xylanase further comprises a signal peptide comprising SEQ ID NO: 329 at its amino terminus.

The fusion protein can comprise a xylanase comprising an amino acid sequence having at least 98% identity to SEQ ID NO: 269. The xylanase further comprises a signal peptide comprising SEQ ID NO: 329 at its amino terminus.

The fusion protein can comprise a xylanase comprising an amino acid sequence having at least 99% identity to SEQ ID NO: 269. The xylanase further comprises a signal peptide comprising SEQ ID NO: 329 at its amino terminus.

The fusion protein can comprise a xylanase comprising an amino acid sequence having 100% identity to SEQ ID NO: 269. The xylanase further comprises a signal peptide comprising SEQ ID NO: 329 at its amino terminus.

Where the fusion protein comprises a signal peptide, the fusion protein can comprise a xylanase comprising an amino acid sequence having at least 70% identity to SEQ ID NO: 270. The xylanase further comprises a signal peptide comprising SEQ ID NO: 330 at its amino terminus.

The fusion protein can comprise a xylanase comprising an amino acid sequence having at least 75% identity to SEQ ID NO: 270. The xylanase further comprises a signal peptide comprising SEQ ID NO: 330 at its amino terminus.

The fusion protein can comprise a xylanase comprising an amino acid sequence having at least 80% identity to SEQ ID NO: 270. The xylanase further comprises a signal peptide comprising SEQ ID NO: 330 at its amino terminus.

The fusion protein can comprise a xylanase comprising an amino acid sequence having at least 85% identity to SEQ ID NO: 270. The xylanase further comprises a signal peptide comprising SEQ ID NO: 330 at its amino terminus.

The fusion protein can comprise a xylanase comprising an amino acid sequence having at least 90% identity to SEQ ID NO: 270. The xylanase further comprises a signal peptide comprising SEQ ID NO: 330 at its amino terminus.

The fusion protein can comprise a xylanase comprising an amino acid sequence having at least 95% identity to SEQ ID NO: 270. The xylanase further comprises a signal peptide comprising SEQ ID NO: 330 at its amino terminus.

The fusion protein can comprise a xylanase comprising an amino acid sequence having at least 98% identity to SEQ ID NO: 270. The xylanase further comprises a signal peptide comprising SEQ ID NO: 330 at its amino terminus.

The fusion protein can comprise a xylanase comprising an amino acid sequence having at least 99% identity to SEQ ID NO: 270. The xylanase further comprises a signal peptide comprising SEQ ID NO: 330 at its amino terminus.

The fusion protein can comprise a xylanase comprising an amino acid sequence having 100% identity to SEQ ID NO: 270. The xylanase further comprises a signal peptide comprising SEQ ID NO: 330 at its amino terminus.

Where the fusion protein comprises a signal peptide, the fusion protein can comprise a xylanase comprising an amino acid sequence having at least 70% identity to SEQ ID NO: 273. The xylanase further comprises a signal peptide comprising SEQ ID NO: 331 at its amino terminus.

The fusion protein can comprise a xylanase comprising an amino acid sequence having at least 75% identity to SEQ ID NO: 273. The xylanase further comprises a signal peptide comprising SEQ ID NO: 331 at its amino terminus.

The fusion protein can comprise a xylanase comprising an amino acid sequence having at least 80% identity to SEQ ID NO: 273. The xylanase further comprises a signal peptide comprising SEQ ID NO: 331 at its amino terminus.

The fusion protein can comprise a xylanase comprising an amino acid sequence having at least 85% identity to SEQ ID NO: 273. The xylanase further comprises a signal peptide comprising SEQ ID NO: 331 at its amino terminus.

The fusion protein can comprise a xylanase comprising an amino acid sequence having at least 90% identity to SEQ ID NO: 273. The xylanase further comprises a signal peptide comprising SEQ ID NO: 331 at its amino terminus.

The fusion protein can comprise a xylanase comprising an amino acid sequence having at least 95% identity to SEQ ID NO: 273. The xylanase further comprises a signal peptide comprising SEQ ID NO: 331 at its amino terminus.

The fusion protein can comprise a xylanase comprising an amino acid sequence having at least 98% identity to SEQ ID NO: 273. The xylanase further comprises a signal peptide comprising SEQ ID NO: 331 at its amino terminus.

The fusion protein can comprise a xylanase comprising an amino acid sequence having at least 99% identity to SEQ ID NO: 273. The xylanase further comprises a signal peptide comprising SEQ ID NO: 331 at its amino terminus.

The fusion protein can comprise a xylanase comprising an amino acid sequence having 100% identity to SEQ ID NO: 273. The xylanase further comprises a signal peptide comprising SEQ ID NO: 331 at its amino terminus.

Where the fusion protein comprises a signal peptide, the fusion protein can comprise a chitosanase consisting essentially of an amino acid sequence having at least 70% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 75% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 80% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 85% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 90% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 95% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 98% identity to SEQ ID NO: 279. The chitosanase further comprises a signal peptide comprising SEQ ID NO: 332 at its amino terminus.

The fusion protein can comprise a chitosanase consisting essentially of an amino acid sequence having at least 99% identity to SEQ ID NO: 279. The chitosanase further comprises a signal peptide comprising SEQ ID NO: 332 at its amino terminus.

The fusion protein can comprise a chitosanase consisting essentially of an amino acid sequence having 100% identity to SEQ ID NO: 279. The chitosanase further comprises a signal peptide comprising SEQ ID NO: 332 at its amino terminus.

Where the fusion protein comprises a signal peptide, the fusion protein can comprise a chitosanase comprising an amino acid sequence having at least 70% identity to SEQ ID NO: 280. The chitosanase further comprises a signal peptide comprising SEQ ID NO: 333 at its amino terminus.

The fusion protein can comprise a chitosanase comprising an amino acid sequence having at least 75% identity to SEQ ID NO: 280. The chitosanase further comprises a signal peptide comprising SEQ ID NO: 333 at its amino terminus.

The fusion protein can comprise a chitosanase comprising an amino acid sequence having at least 80% identity to SEQ ID NO: 280. The chitosanase further comprises a signal peptide comprising SEQ ID NO: 333 at its amino terminus.

The fusion protein can comprise a chitosanase comprising an amino acid sequence having at least 85% identity to SEQ ID NO: 280. The chitosanase further comprises a signal peptide comprising SEQ ID NO: 333 at its amino terminus.

The fusion protein can comprise a chitosanase comprising an amino acid sequence having at least 90% identity to SEQ ID NO: 280. The chitosanase further comprises a signal peptide comprising SEQ ID NO: 333 at its amino terminus.

The fusion protein can comprise a chitosanase comprising an amino acid sequence having at least 95% identity to SEQ ID NO: 280. The chitosanase further comprises a signal peptide comprising SEQ ID NO: 333 at its amino terminus.

The fusion protein can comprise a chitosanase comprising an amino acid sequence having at least 98% identity to SEQ ID NO: 280. The chitosanase further comprises a signal peptide comprising SEQ ID NO: 333 at its amino terminus.

The fusion protein can comprise a chitosanase comprising an amino acid sequence having at least 99% identity to SEQ ID NO: 280. The chitosanase further comprises a signal peptide comprising SEQ ID NO: 333 at its amino terminus.

The fusion protein can comprise a chitosanase comprising an amino acid sequence having 100% identity to SEQ ID NO: 280. The chitosanase further comprises a signal peptide comprising SEQ ID NO: 333 at its amino terminus.

Where the fusion protein comprises a signal peptide, the fusion protein can comprise a glucanase consisting essentially of an amino acid sequence having at least 70% identity to SEQ ID NO: 294. The glucanase further comprises a signal peptide comprising SEQ ID NO: 334 at its amino terminus.

The fusion protein can comprise a glucanase consisting essentially of an amino acid sequence having at least 75% identity to SEQ ID NO: 294. The glucanase further comprises a signal peptide comprising SEQ ID NO: 334 at its amino terminus.

The fusion protein can comprise a glucanase consisting essentially of an amino acid sequence having at least 80% identity to SEQ ID NO: 294. The glucanase further comprises a signal peptide comprising SEQ ID NO: 334 at its amino terminus.

The fusion protein can comprise a glucanase consisting essentially of an amino acid sequence having at least 85% identity to SEQ ID NO: 294. The glucanase further comprises a signal peptide comprising SEQ ID NO: 334 at its amino terminus.

The fusion protein can comprise a glucanase consisting essentially of an amino acid sequence having at least 90% identity to SEQ ID NO: 294. The glucanase further comprises a signal peptide comprising SEQ ID NO: 334 at its amino terminus.

The fusion protein can comprise a glucanase consisting essentially of an amino acid sequence having at least 95% identity to SEQ ID NO: 294. The glucanase further comprises a signal peptide comprising SEQ ID NO: 334 at its amino terminus.

The fusion protein can comprise a glucanase consisting essentially of an amino acid sequence having at least 98% identity to SEQ ID NO: 294. The glucanase further comprises a signal peptide comprising SEQ ID NO: 334 at its amino terminus.

The fusion protein can comprise a glucanase consisting essentially of an amino acid sequence having at least 99% identity to SEQ ID NO: 294. The glucanase further comprises a signal peptide comprising SEQ ID NO: 334 at its amino terminus.

The fusion protein can comprise a glucanase consisting essentially of an amino acid sequence having 100% identity to SEQ ID NO: 294. The glucanase further comprises a signal peptide comprising SEQ ID NO: 334 at its amino terminus.

Where the fusion protein comprises a signal peptide, the fusion protein can comprise a glucanase comprising an amino acid sequence having at least 70% identity to SEQ ID NO: 295. The glucanase further comprises a signal peptide comprising SEQ ID NO: 335 at its amino terminus.

The fusion protein can comprise a glucanase comprising an amino acid sequence having at least 75% identity to SEQ ID NO: 295. The glucanase further comprises a signal peptide comprising SEQ ID NO: 335 at its amino terminus.

The fusion protein can comprise a glucanase comprising an amino acid sequence having at least 80% identity to SEQ ID NO: 295. The glucanase further comprises a signal peptide comprising SEQ ID NO: 335 at its amino terminus.

The fusion protein can comprise a glucanase comprising an amino acid sequence having at least 85% identity to SEQ ID NO: 295. The glucanase further comprises a signal peptide comprising SEQ ID NO: 335 at its amino terminus.

The fusion protein can comprise a glucanase comprising an amino acid sequence having at least 90% identity to SEQ ID NO: 295. The glucanase further comprises a signal peptide comprising SEQ ID NO: 335 at its amino terminus.

The fusion protein can comprise a glucanase comprising an amino acid sequence having at least 95% identity to SEQ ID NO: 295. The glucanase further comprises a signal peptide comprising SEQ ID NO: 335 at its amino terminus.

The fusion protein can comprise a glucanase comprising an amino acid sequence having at least 98% identity to SEQ ID NO: 295. The glucanase further comprises a signal peptide comprising SEQ ID NO: 335 at its amino terminus.

The fusion protein can comprise a glucanase comprising an amino acid sequence having at least 99% identity to SEQ ID NO: 295. The glucanase further comprises a signal peptide comprising SEQ ID NO: 335 at its amino terminus.

The fusion protein can comprise a glucanase comprising an amino acid sequence having 100% identity to SEQ ID NO: 295. The glucanase further comprises a signal peptide comprising SEQ ID NO: 335 at its amino terminus.

Where the fusion protein comprises a signal peptide, the fusion protein can comprise a glucanase comprising an amino acid sequence having at least 70% identity to SEQ ID NO: 296. The glucanase further comprises a signal peptide comprising SEQ ID NO: 336 at its amino terminus.

The fusion protein can comprise a glucanase comprising an amino acid sequence having at least 75% identity to SEQ ID NO: 296. The glucanase further comprises a signal peptide comprising SEQ ID NO: 336 at its amino terminus.

The fusion protein can comprise a glucanase comprising an amino acid sequence having at least 80% identity to SEQ ID NO: 296. The glucanase further comprises a signal peptide comprising SEQ ID NO: 336 at its amino terminus.

The fusion protein can comprise a glucanase comprising an amino acid sequence having at least 85% identity to SEQ ID NO: 296. The glucanase further comprises a signal peptide comprising SEQ ID NO: 336 at its amino terminus.

The fusion protein can comprise a glucanase comprising an amino acid sequence having at least 90% identity to SEQ ID NO: 296. The glucanase further comprises a signal peptide comprising SEQ ID NO: 336 at its amino terminus.

The fusion protein can comprise a glucanase comprising an amino acid sequence having at least 95% identity to SEQ ID NO: 296. The glucanase further comprises a signal peptide comprising SEQ ID NO: 336 at its amino terminus.

The fusion protein can comprise a glucanase comprising an amino acid sequence having at least 98% identity to SEQ ID NO: 296. The glucanase further comprises a signal peptide comprising SEQ ID NO: 336 at its amino terminus.

The fusion protein can comprise a glucanase comprising an amino acid sequence having at least 99% identity to SEQ ID NO: 296. The glucanase further comprises a signal peptide comprising SEQ ID NO: 336 at its amino terminus.

The fusion protein can comprise a glucanase comprising an amino acid sequence having 100% identity to SEQ ID NO: 296. The glucanase further comprises a signal peptide comprising SEQ ID NO: 336 at its amino terminus.

Where the fusion protein comprises a signal peptide, the fusion protein can comprise a glucanase comprising an amino acid sequence having at least 70% identity to SEQ ID NO: 297. The glucanase further comprises a signal peptide comprising SEQ ID NO: 337 at its amino terminus.

The fusion protein can comprise a glucanase comprising an amino acid sequence having at least 75% identity to SEQ ID NO: 297. The glucanase further comprises a signal peptide comprising SEQ ID NO: 337 at its amino terminus.

The fusion protein can comprise a glucanase comprising an amino acid sequence having at least 80% identity to SEQ ID NO: 297. The glucanase further comprises a signal peptide comprising SEQ ID NO: 337 at its amino terminus.

The fusion protein can comprise a glucanase comprising an amino acid sequence having at least 85% identity to SEQ ID NO: 297. The glucanase further comprises a signal peptide comprising SEQ ID NO: 337 at its amino terminus.

The fusion protein can comprise a glucanase comprising an amino acid sequence having at least 90% identity to SEQ ID NO: 297. The glucanase further comprises a signal peptide comprising SEQ ID NO: 337 at its amino terminus.

The fusion protein can comprise a glucanase comprising an amino acid sequence having at least 95% identity to SEQ ID NO: 297. The glucanase further comprises a signal peptide comprising SEQ ID NO: 337 at its amino terminus.

The fusion protein can comprise a glucanase comprising an amino acid sequence having at least 98% identity to SEQ ID NO: 297. The glucanase further comprises a signal peptide comprising SEQ ID NO: 337 at its amino terminus.

The fusion protein can comprise a glucanase comprising an amino acid sequence having at least 99% identity to SEQ ID NO: 297. The glucanase further comprises a signal peptide comprising SEQ ID NO: 337 at its amino terminus.

The fusion protein can comprise a glucanase comprising an amino acid sequence having 100% identity to SEQ ID NO: 297. The glucanase further comprises a signal peptide comprising SEQ ID NO: 337 at its amino terminus.

Where the fusion protein comprises a signal peptide, the fusion protein can comprise a glucanase comprising an amino acid sequence having at least 70% identity to SEQ ID NO: 298. The glucanase further comprises a signal peptide comprising SEQ ID NO: 338 at its amino terminus.

The fusion protein can comprise a glucanase comprising an amino acid sequence having at least 75% identity to SEQ ID NO: 298. The glucanase further comprises a signal peptide comprising SEQ ID NO: 338 at its amino terminus.

The fusion protein can comprise a glucanase comprising an amino acid sequence having at least 80% identity to SEQ ID NO: 298. The glucanase further comprises a signal peptide comprising SEQ ID NO: 338 at its amino terminus.

The fusion protein can comprise a glucanase comprising an amino acid sequence having at least 85% identity to SEQ ID NO: 298. The glucanase further comprises a signal peptide comprising SEQ ID NO: 338 at its amino terminus.

The fusion protein can comprise a glucanase comprising an amino acid sequence having at least 90% identity to SEQ ID NO: 298. The glucanase further comprises a signal peptide comprising SEQ ID NO: 338 at its amino terminus.

The fusion protein can comprise a glucanase comprising an amino acid sequence having at least 95% identity to SEQ ID NO: 298. The glucanase further comprises a signal peptide comprising SEQ ID NO: 338 at its amino terminus.

The fusion protein can comprise a glucanase comprising an amino acid sequence having at least 98% identity to SEQ ID NO: 298. The glucanase further comprises a signal peptide comprising SEQ ID NO: 338 at its amino terminus.

The fusion protein can comprise a glucanase comprising an amino acid sequence having at least 99% identity to SEQ ID NO: 298. The glucanase further comprises a signal peptide comprising SEQ ID NO: 338 at its amino terminus.

The fusion protein can comprise a glucanase comprising an amino acid sequence having 100% identity to SEQ ID NO: 298. The glucanase further comprises a signal peptide comprising SEQ ID NO: 338 at its amino terminus.

Where the fusion protein comprises a signal peptide, the fusion protein can comprise a glucanase comprising an amino acid sequence having at least 70% identity to SEQ ID NO: 299. The glucanase further comprises a signal peptide comprising SEQ ID NO: 339 at its amino terminus.

The fusion protein can comprise a glucanase comprising an amino acid sequence having at least 75% identity to SEQ ID NO: 299. The glucanase further comprises a signal peptide comprising SEQ ID NO: 339 at its amino terminus.

The fusion protein can comprise a glucanase comprising an amino acid sequence having at least 80% identity to SEQ ID NO: 299. The glucanase further comprises a signal peptide comprising SEQ ID NO: 339 at its amino terminus.

The fusion protein can comprise a glucanase comprising an amino acid sequence having at least 85% identity to SEQ ID NO: 299. The glucanase further comprises a signal peptide comprising SEQ ID NO: 339 at its amino terminus.

The fusion protein can comprise a glucanase comprising an amino acid sequence having at least 90% identity to SEQ ID NO: 299. The glucanase further comprises a signal peptide comprising SEQ ID NO: 339 at its amino terminus.

The fusion protein can comprise a glucanase comprising an amino acid sequence having at least 95% identity to SEQ ID NO: 299. The glucanase further comprises a signal peptide comprising SEQ ID NO: 339 at its amino terminus.

The fusion protein can comprise a glucanase comprising an amino acid sequence having at least 98% identity to SEQ ID NO: 299. The glucanase further comprises a signal peptide comprising SEQ ID NO: 339 at its amino terminus.

The fusion protein can comprise a glucanase comprising an amino acid sequence having at least 99% identity to SEQ ID NO: 299. The glucanase further comprises a signal peptide comprising SEQ ID NO: 339 at its amino terminus.

The fusion protein can comprise a glucanase comprising an amino acid sequence having 100% identity to SEQ ID NO: 299. The glucanase further comprises a signal peptide comprising SEQ ID NO: 339 at its amino terminus.

Where the fusion protein comprises a signal peptide, the fusion protein can comprise a glucanase comprising an amino acid sequence having at least 70% identity to SEQ ID NO: 300. The glucanase further comprises a signal peptide comprising SEQ ID NO: 340 at its amino terminus.

The fusion protein can comprise a glucanase comprising an amino acid sequence having at least 75% identity to SEQ ID NO: 300. The glucanase further comprises a signal peptide comprising SEQ ID NO: 340 at its amino terminus.

The fusion protein can comprise a glucanase comprising an amino acid sequence having at least 80% identity to SEQ ID NO: 300. The glucanase further comprises a signal peptide comprising SEQ ID NO: 340 at its amino terminus.

The fusion protein can comprise a glucanase comprising an amino acid sequence having at least 85% identity to SEQ ID NO: 300. The glucanase further comprises a signal peptide comprising SEQ ID NO: 340 at its amino terminus.

The fusion protein can comprise a glucanase comprising an amino acid sequence having at least 90% identity to SEQ ID NO: 300. The glucanase further comprises a signal peptide comprising SEQ ID NO: 340 at its amino terminus.

The fusion protein can comprise a glucanase comprising an amino acid sequence having at least 95% identity to SEQ ID NO: 300. The glucanase further comprises a signal peptide comprising SEQ ID NO: 340 at its amino terminus.

The fusion protein can comprise a glucanase comprising an amino acid sequence having at least 98% identity to SEQ ID NO: 300. The glucanase further comprises a signal peptide comprising SEQ ID NO: 340 at its amino terminus.

The fusion protein can comprise a glucanase comprising an amino acid sequence having at least 99% identity to SEQ ID NO: 300. The glucanase further comprises a signal peptide comprising SEQ ID NO: 340 at its amino terminus.

The fusion protein can comprise a glucanase comprising an amino acid sequence having 100% identity to SEQ ID NO: 300. The glucanase further comprises a signal peptide comprising SEQ ID NO: 340 at its amino terminus.

Where the fusion protein comprises a signal peptide, the fusion protein can comprise a glucanase comprising an amino acid sequence having at least 70% identity to SEQ ID NO: 302. The glucanase further comprises a signal peptide comprising SEQ ID NO: 341 at its amino terminus.

The fusion protein can comprise a glucanase comprising an amino acid sequence having at least 75% identity to SEQ ID NO: 302. The glucanase further comprises a signal peptide comprising SEQ ID NO: 341 at its amino terminus.

The fusion protein can comprise a glucanase comprising an amino acid sequence having at least 80% identity to SEQ ID NO: 302. The glucanase further comprises a signal peptide comprising SEQ ID NO: 341 at its amino terminus.

The fusion protein can comprise a glucanase comprising an amino acid sequence having at least 85% identity to SEQ ID NO: 302. The glucanase further comprises a signal peptide comprising SEQ ID NO: 341 at its amino terminus.

The fusion protein can comprise a glucanase comprising an amino acid sequence having at least 90% identity to SEQ ID NO: 302. The glucanase further comprises a signal peptide comprising SEQ ID NO: 341 at its amino terminus.

The fusion protein can comprise a glucanase comprising an amino acid sequence having at least 95% identity to SEQ ID NO: 302. The glucanase further comprises a signal peptide comprising SEQ ID NO: 341 at its amino terminus.

The fusion protein can comprise a glucanase comprising an amino acid sequence having at least 98% identity to SEQ ID NO: 302. The glucanase further comprises a signal peptide comprising SEQ ID NO: 341 at its amino terminus.

The fusion protein can comprise a glucanase comprising an amino acid sequence having at least 99% identity to SEQ ID NO: 302. The glucanase further comprises a signal peptide comprising SEQ ID NO: 341 at its amino terminus.

The fusion protein can comprise a glucanase comprising an amino acid sequence having 100% identity to SEQ ID NO: 302. The glucanase further comprises a signal peptide comprising SEQ ID NO: 341 at its amino terminus.

Where the fusion protein comprises a signal peptide, the fusion protein can comprise a protease comprising an amino acid sequence having at least 70% identity to SEQ ID NO: 304. The protease further comprises a signal peptide comprising SEQ ID NO: 342 at its amino terminus.

The fusion protein can comprise a protease comprising an amino acid sequence having at least 75% identity to SEQ ID NO: 304. The protease further comprises a signal peptide comprising SEQ ID NO: 342 at its amino terminus.

The fusion protein can comprise a protease comprising an amino acid sequence having at least 80% identity to SEQ ID NO: 304. The protease further comprises a signal peptide comprising SEQ ID NO: 342 at its amino terminus.

The fusion protein can comprise a protease comprising an amino acid sequence having at least 85% identity to SEQ ID NO: 304. The protease further comprises a signal peptide comprising SEQ ID NO: 342 at its amino terminus.

The fusion protein can comprise a protease comprising an amino acid sequence having at least 90% identity to SEQ ID NO: 304. The protease further comprises a signal peptide comprising SEQ ID NO: 342 at its amino terminus.

The fusion protein can comprise a protease comprising an amino acid sequence having at least 95% identity to SEQ ID NO: 304. The protease further comprises a signal peptide comprising SEQ ID NO: 342 at its amino terminus.

The fusion protein can comprise a protease comprising an amino acid sequence having at least 98% identity to SEQ ID NO: 304. The protease further comprises a signal peptide comprising SEQ ID NO: 342 at its amino terminus.

The fusion protein can comprise a protease comprising an amino acid sequence having at least 99% identity to SEQ ID NO: 304. The protease further comprises a signal peptide comprising SEQ ID NO: 342 at its amino terminus.

The fusion protein can comprise a protease comprising an amino acid sequence having 100% identity to SEQ ID NO: 304. The protease further comprises a signal peptide comprising SEQ ID NO: 342 at its amino terminus.

Where the fusion protein comprises a signal peptide, the fusion protein can comprise a protease comprising an amino acid sequence having at least 70% identity to SEQ ID NO: 306. The protease further comprises a signal peptide comprising SEQ ID NO: 343 at its amino terminus.

The fusion protein can comprise a protease comprising an amino acid sequence having at least 75% identity to SEQ ID NO: 306. The protease further comprises a signal peptide comprising SEQ ID NO: 343 at its amino terminus.

The fusion protein can comprise a protease comprising an amino acid sequence having at least 80% identity to SEQ ID NO: 306. The protease further comprises a signal peptide comprising SEQ ID NO: 343 at its amino terminus.

The fusion protein can comprise a protease comprising an amino acid sequence having at least 85% identity to SEQ ID NO: 306. The protease further comprises a signal peptide comprising SEQ ID NO: 343 at its amino terminus.

The fusion protein can comprise a protease comprising an amino acid sequence having at least 90% identity to SEQ ID NO: 306. The protease further comprises a signal peptide comprising SEQ ID NO: 343 at its amino terminus.

The fusion protein can comprise a protease comprising an amino acid sequence having at least 95% identity to SEQ ID NO: 306. The protease further comprises a signal peptide comprising SEQ ID NO: 343 at its amino terminus.

The fusion protein can comprise a protease comprising an amino acid sequence having at least 98% identity to SEQ ID NO: 306. The protease further comprises a signal peptide comprising SEQ ID NO: 343 at its amino terminus.

The fusion protein can comprise a protease comprising an amino acid sequence having at least 99% identity to SEQ ID NO: 306. The protease further comprises a signal peptide comprising SEQ ID NO: 343 at its amino terminus.

The fusion protein can comprise a protease comprising an amino acid sequence having 100% identity to SEQ ID NO: 306. The protease further comprises a signal peptide comprising SEQ ID NO: 343 at its amino terminus.

Where the fusion protein comprises a signal peptide, the fusion protein can comprise a mannanase comprising an amino acid sequence having at least 70% identity to SEQ ID NO: 307. The mannanase further comprises a signal peptide comprising SEQ ID NO: 344 at its amino terminus.

The fusion protein can comprise a mannanase comprising an amino acid sequence having at least 75% identity to SEQ ID NO: 307. The mannanase further comprises a signal peptide comprising SEQ ID NO: 344 at its amino terminus.

The fusion protein can comprise a mannanase comprising an amino acid sequence having at least 80% identity to SEQ ID NO: 307. The mannanase further comprises a signal peptide comprising SEQ ID NO: 344 at its amino terminus.

The fusion protein can comprise a mannanase comprising an amino acid sequence having at least 85% identity to SEQ ID NO: 307. The mannanase further comprises a signal peptide comprising SEQ ID NO: 344 at its amino terminus.

The fusion protein can comprise a mannanase comprising an amino acid sequence having at least 90% identity to SEQ ID NO: 307. The mannanase further comprises a signal peptide comprising SEQ ID NO: 344 at its amino terminus.

The fusion protein can comprise a mannanase comprising an amino acid sequence having at least 95% identity to SEQ ID NO: 307. The mannanase further comprises a signal peptide comprising SEQ ID NO: 344 at its amino terminus.

The fusion protein can comprise a mannanase comprising an amino acid sequence having at least 98% identity to SEQ ID NO: 307. The mannanase further comprises a signal peptide comprising SEQ ID NO: 344 at its amino terminus.

The fusion protein can comprise a mannanase comprising an amino acid sequence having at least 99% identity to SEQ ID NO: 307. The mannanase further comprises a signal peptide comprising SEQ ID NO: 344 at its amino terminus.

The fusion protein can comprise a mannanase comprising an amino acid sequence having 100% identity to SEQ ID NO: 307. The mannanase further comprises a signal peptide comprising SEQ ID NO: 344 at its amino terminus.

Where the fusion protein comprises a signal peptide, the fusion protein can comprise a mannanase comprising an amino acid sequence having at least 70% identity to SEQ ID NO: 308. The mannanase further comprises a signal peptide comprising SEQ ID NO: 345 at its amino terminus.

The fusion protein can comprise a mannanase comprising an amino acid sequence having at least 75% identity to SEQ ID NO: 308. The mannanase further comprises a signal peptide comprising SEQ ID NO: 345 at its amino terminus.

The fusion protein can comprise a mannanase comprising an amino acid sequence having at least 80% identity to SEQ ID NO: 308. The mannanase further comprises a signal peptide comprising SEQ ID NO: 345 at its amino terminus.

The fusion protein can comprise a mannanase comprising an amino acid sequence having at least 85% identity to SEQ ID NO: 308. The mannanase further comprises a signal peptide comprising SEQ ID NO: 345 at its amino terminus.

The fusion protein can comprise a mannanase comprising an amino acid sequence having at least 90% identity to SEQ ID NO: 308. The mannanase further comprises a signal peptide comprising SEQ ID NO: 345 at its amino terminus.

The fusion protein can comprise a mannanase comprising an amino acid sequence having at least 95% identity to SEQ ID NO: 308. The mannanase further comprises a signal peptide comprising SEQ ID NO: 345 at its amino terminus.

The fusion protein can comprise a mannanase comprising an amino acid sequence having at least 98% identity to SEQ ID NO: 308. The mannanase further comprises a signal peptide comprising SEQ ID NO: 345 at its amino terminus.

The fusion protein can comprise a mannanase comprising an amino acid sequence having at least 99% identity to SEQ ID NO: 308. The mannanase further comprises a signal peptide comprising SEQ ID NO: 345 at its amino terminus.

The fusion protein can comprise a mannanase comprising an amino acid sequence having 100% identity to SEQ ID NO: 308. The mannanase further comprises a signal peptide comprising SEQ ID NO: 345 at its amino terminus.

Where the fusion protein comprises a signal peptide, the fusion protein can comprise a pectolyase comprising an amino acid sequence having at least 70% identity to SEQ ID NO: 309. The pectolyase further comprises a signal peptide comprising SEQ ID NO: 346 at its amino terminus.

The fusion protein can comprise a pectolyase comprising an amino acid sequence having at least 75% identity to SEQ ID NO: 309. The pectolyase further comprises a signal peptide comprising SEQ ID NO: 346 at its amino terminus.

The fusion protein can comprise a pectolyase comprising an amino acid sequence having at least 80% identity to SEQ ID NO: 309. The pectolyase further comprises a signal peptide comprising SEQ ID NO: 346 at its amino terminus.

The fusion protein can comprise a pectolyase comprising an amino acid sequence having at least 85% identity to SEQ ID NO: 309. The pectolyase further comprises a signal peptide comprising SEQ ID NO: 346 at its amino terminus.

The fusion protein can comprise a pectolyase comprising an amino acid sequence having at least 90% identity to SEQ ID NO: 309. The pectolyase further comprises a signal peptide comprising SEQ ID NO: 346 at its amino terminus.

The fusion protein can comprise a pectolyase comprising an amino acid sequence having at least 95% identity to SEQ ID NO: 309. The pectolyase further comprises a signal peptide comprising SEQ ID NO: 346 at its amino terminus.

The fusion protein can comprise a pectolyase comprising an amino acid sequence having at least 98% identity to SEQ ID NO: 309. The pectolyase further comprises a signal peptide comprising SEQ ID NO: 346 at its amino terminus.

The fusion protein can comprise a pectolyase comprising an amino acid sequence having at least 99% identity to SEQ ID NO: 309. The pectolyase further comprises a signal peptide comprising SEQ ID NO: 346 at its amino terminus.

The fusion protein can comprise a pectolyase comprising an amino acid sequence having 100% identity to SEQ ID NO: 309. The pectolyase further comprises a signal peptide comprising SEQ ID NO: 346 at its amino terminus.

Where the fusion protein comprises a signal peptide, the fusion protein can comprise a pectolyase comprising an amino acid sequence having at least 70% identity to SEQ ID NO: 310. The pectolyase further comprises a signal peptide comprising SEQ ID NO: 347 at its amino terminus.

The fusion protein can comprise a pectolyase comprising an amino acid sequence having at least 75% identity to SEQ ID NO: 310. The pectolyase further comprises a signal peptide comprising SEQ ID NO: 347 at its amino terminus.

The fusion protein can comprise a pectolyase comprising an amino acid sequence having at least 80% identity to SEQ ID NO: 310. The pectolyase further comprises a signal peptide comprising SEQ ID NO: 347 at its amino terminus.

The fusion protein can comprise a pectolyase comprising an amino acid sequence having at least 85% identity to SEQ ID NO: 310. The pectolyase further comprises a signal peptide comprising SEQ ID NO: 347 at its amino terminus.

The fusion protein can comprise a pectolyase comprising an amino acid sequence having at least 90% identity to SEQ ID NO: 310. The pectolyase further comprises a signal peptide comprising SEQ ID NO: 347 at its amino terminus.

The fusion protein can comprise a pectolyase comprising an amino acid sequence having at least 95% identity to SEQ ID NO: 310. The pectolyase further comprises a signal peptide comprising SEQ ID NO: 347 at its amino terminus.

The fusion protein can comprise a pectolyase comprising an amino acid sequence having at least 98% identity to SEQ ID NO: 310. The pectolyase further comprises a signal peptide comprising SEQ ID NO: 347 at its amino terminus.

The fusion protein can comprise a pectolyase comprising an amino acid sequence having at least 99% identity to SEQ ID NO: 310. The pectolyase further comprises a signal peptide comprising SEQ ID NO: 347 at its amino terminus.

The fusion protein can comprise a pectolyase comprising an amino acid sequence having 100% identity to SEQ ID NO: 310. The pectolyase further comprises a signal peptide comprising SEQ ID NO: 347 at its amino terminus.

Where the fusion protein comprises a signal peptide, the fusion protein can comprise an acid phosphatase comprising an amino acid sequence having at least 70% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 75% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 80% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 85% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 90% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 95% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 98% identity to SEQ ID NO: 311. The acid phosphatase further comprises a signal peptide comprising SEQ ID NO: 348 at its amino terminus.

The fusion protein can comprise an acid phosphatase comprising an amino acid sequence having at least 99% identity to SEQ ID NO: 311. The acid phosphatase further comprises a signal peptide comprising SEQ ID NO: 348 at its amino terminus.

The fusion protein can comprise an acid phosphatase comprising an amino acid sequence having 100% identity to SEQ ID NO: 311. The acid phosphatase further comprises a signal peptide comprising SEQ ID NO: 348 at its amino terminus.

Where the fusion protein comprises a signal peptide, the fusion protein can comprise an acid phosphatase comprising an amino acid sequence having at least 70% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 75% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 80% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 85% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 90% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 95% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 98% identity to SEQ ID NO: 312. The acid phosphatase further comprises a signal peptide comprising SEQ ID NO: 349 at its amino terminus.

The fusion protein can comprise an acid phosphatase comprising an amino acid sequence having at least 99% identity to SEQ ID NO: 312. The acid phosphatase further comprises a signal peptide comprising SEQ ID NO: 349 at its amino terminus.

The fusion protein can comprise an acid phosphatase comprising an amino acid sequence having 100% identity to SEQ ID NO: 312. The acid phosphatase further comprises a signal peptide comprising SEQ ID NO: 349 at its amino terminus.

Where the fusion protein comprises a signal peptide, the fusion protein can comprise an acid phosphatase comprising an amino acid sequence having at least 70% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 75% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 80% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 85% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 90% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 95% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 98% identity to SEQ ID NO: 378. The acid phosphatase further comprises a signal peptide comprising SEQ ID NO: 379 at its amino terminus.

The fusion protein can comprise an acid phosphatase comprising an amino acid sequence having at least 99% identity to SEQ ID NO: 378. The acid phosphatase further comprises a signal peptide comprising SEQ ID NO: 379 at its amino terminus.

The fusion protein can comprise an acid phosphatase comprising an amino acid sequence having 100% identity to SEQ ID NO: 378. The acid phosphatase further comprises a signal peptide comprising SEQ ID NO: 379 at its amino terminus.

Where the fusion protein comprises a signal peptide, the fusion protein can comprise a phytase comprising an amino acid sequence having at least 70% identity to SEQ ID NO: 313. The phytase further comprises a signal peptide comprising SEQ ID NO: 350 at its amino terminus.

The fusion protein can comprise a phytase comprising an amino acid sequence having at least 75% identity to SEQ ID NO: 313. The phytase further comprises a signal peptide comprising SEQ ID NO: 350 at its amino terminus.

The fusion protein can comprise a phytase comprising an amino acid sequence having at least 80% identity to SEQ ID NO: 313. The phytase further comprises a signal peptide comprising SEQ ID NO: 350 at its amino terminus.

The fusion protein can comprise a phytase comprising an amino acid sequence having at least 85% identity to SEQ ID NO: 313. The phytase further comprises a signal peptide comprising SEQ ID NO: 350 at its amino terminus.

The fusion protein can comprise a phytase comprising an amino acid sequence having at least 90% identity to SEQ ID NO: 313. The phytase further comprises a signal peptide comprising SEQ ID NO: 350 at its amino terminus.

The fusion protein can comprise a phytase comprising an amino acid sequence having at least 95% identity to SEQ ID NO: 313. The phytase further comprises a signal peptide comprising SEQ ID NO: 350 at its amino terminus.

The fusion protein can comprise a phytase comprising an amino acid sequence having at least 98% identity to SEQ ID NO: 313. The phytase further comprises a signal peptide comprising SEQ ID NO: 350 at its amino terminus.

The fusion protein can comprise a phytase comprising an amino acid sequence having at least 99% identity to SEQ ID NO: 313. The phytase further comprises a signal peptide comprising SEQ ID NO: 350 at its amino terminus.

The fusion protein can comprise a phytase comprising an amino acid sequence having 100% identity to SEQ ID NO: 313. The phytase further comprises a signal peptide comprising SEQ ID NO: 350 at its amino terminus.

Where the fusion protein comprises a signal peptide, the fusion protein can comprise a phytase comprising an amino acid sequence having at least 70% identity to SEQ ID NO: 314. The phytase further comprises a signal peptide comprising SEQ ID NO: 350 at its amino terminus.

The fusion protein can comprise a phytase comprising an amino acid sequence having at least 75% identity to SEQ ID NO: 314. The phytase further comprises a signal peptide comprising SEQ ID NO: 350 at its amino terminus.

The fusion protein can comprise a phytase comprising an amino acid sequence having at least 80% identity to SEQ ID NO: 314. The phytase further comprises a signal peptide comprising SEQ ID NO: 350 at its amino terminus.

The fusion protein can comprise a phytase comprising an amino acid sequence having at least 85% identity to SEQ ID NO: 314. The phytase further comprises a signal peptide comprising SEQ ID NO: 350 at its amino terminus.

The fusion protein can comprise a phytase comprising an amino acid sequence having at least 90% identity to SEQ ID NO: 314. The phytase further comprises a signal peptide comprising SEQ ID NO: 350 at its amino terminus.

The fusion protein can comprise a phytase comprising an amino acid sequence having at least 95% identity to SEQ ID NO: 314. The phytase further comprises a signal peptide comprising SEQ ID NO: 350 at its amino terminus.

The fusion protein can comprise a phytase comprising an amino acid sequence having at least 98% identity to SEQ ID NO: 314. The phytase further comprises a signal peptide comprising SEQ ID NO: 350 at its amino terminus.

The fusion protein can comprise a phytase comprising an amino acid sequence having at least 99% identity to SEQ ID NO: 314. The phytase further comprises a signal peptide comprising SEQ ID NO: 350 at its amino terminus.

The fusion protein can comprise a phytase comprising an amino acid sequence having 100% identity to SEQ ID NO: 314. The phytase further comprises a signal peptide comprising SEQ ID NO: 350 at its amino terminus.

Where the fusion protein comprises a signal peptide, the fusion protein can comprise a phytase comprising an amino acid sequence having at least 70% identity to SEQ ID NO: 315. The phytase further comprises a signal peptide comprising SEQ ID NO: 351 at its amino terminus.

The fusion protein can comprise a phytase comprising an amino acid sequence having at least 75% identity to SEQ ID NO: 315. The phytase further comprises a signal peptide comprising SEQ ID NO: 351 at its amino terminus.

The fusion protein can comprise a phytase comprising an amino acid sequence having at least 80% identity to SEQ ID NO: 315. The phytase further comprises a signal peptide comprising SEQ ID NO: 351 at its amino terminus.

The fusion protein can comprise a phytase comprising an amino acid sequence having at least 85% identity to SEQ ID NO: 315. The phytase further comprises a signal peptide comprising SEQ ID NO: 351 at its amino terminus.

The fusion protein can comprise a phytase comprising an amino acid sequence having at least 90% identity to SEQ ID NO: 315. The phytase further comprises a signal peptide comprising SEQ ID NO: 351 at its amino terminus.

The fusion protein can comprise a phytase comprising an amino acid sequence having at least 95% identity to SEQ ID NO: 315. The phytase further comprises a signal peptide comprising SEQ ID NO: 351 at its amino terminus.

The fusion protein can comprise a phytase comprising an amino acid sequence having at least 98% identity to SEQ ID NO: 315. The phytase further comprises a signal peptide comprising SEQ ID NO: 351 at its amino terminus.

The fusion protein can comprise a phytase comprising an amino acid sequence having at least 99% identity to SEQ ID NO: 315. The phytase further comprises a signal peptide comprising SEQ ID NO: 351 at its amino terminus.

The fusion protein can comprise a phytase comprising an amino acid sequence having 100% identity to SEQ ID NO: 315. The phytase further comprises a signal peptide comprising SEQ ID NO: 351 at its amino terminus.

Where the fusion protein comprises a signal peptide, the fusion protein can comprise a phytase comprising an amino acid sequence having at least 70% identity to SEQ ID NO: 380. The phytase further comprises a signal peptide comprising SEQ ID NO: 354 at its amino terminus.

The fusion protein can comprise a phytase comprising an amino acid sequence having at least 75% identity to SEQ ID NO: 380. The phytase further comprises a signal peptide comprising SEQ ID NO: 354 at its amino terminus.

The fusion protein can comprise a phytase comprising an amino acid sequence having at least 80% identity to SEQ ID NO: 380. The phytase further comprises a signal peptide comprising SEQ ID NO: 354 at its amino terminus.

The fusion protein can comprise a phytase comprising an amino acid sequence having at least 85% identity to SEQ ID NO: 380. The phytase further comprises a signal peptide comprising SEQ ID NO: 354 at its amino terminus.

The fusion protein can comprise a phytase comprising an amino acid sequence having at least 90% identity to SEQ ID NO: 380. The phytase further comprises a signal peptide comprising SEQ ID NO: 354 at its amino terminus.

The fusion protein can comprise a phytase comprising an amino acid sequence having at least 95% identity to SEQ ID NO: 380. The phytase further comprises a signal peptide comprising SEQ ID NO: 354 at its amino terminus.

The fusion protein can comprise a phytase comprising an amino acid sequence having at least 98% identity to SEQ ID NO: 380. The phytase further comprises a signal peptide comprising SEQ ID NO: 354 at its amino terminus.

The fusion protein can comprise a phytase comprising an amino acid sequence having at least 99% identity to SEQ ID NO: 380. The phytase further comprises a signal peptide comprising SEQ ID NO: 354 at its amino terminus.

The fusion protein can comprise a phytase comprising an amino acid sequence having 100% identity to SEQ ID NO: 380. The phytase further comprises a signal peptide comprising SEQ ID NO: 354 at its amino terminus. Where the fusion protein comprises a signal peptide, the fusion protein can comprise an expansin protein comprising an amino acid sequence having at least 70% identity to SEQ ID NO: 316. The expansin protein further comprises a signal peptide comprising SEQ ID NO: 352 at its amino terminus.

The fusion protein can comprise an expansin protein comprising an amino acid sequence having at least 75% identity to SEQ ID NO: 316. The expansin protein further comprises a signal peptide comprising SEQ ID NO: 352 at its amino terminus.

The fusion protein can comprise an expansin protein comprising an amino acid sequence having at least 80% identity to SEQ ID NO: 316. The expansin protein further comprises a signal peptide comprising SEQ ID NO: 352 at its amino terminus.

The fusion protein can comprise an expansin protein comprising an amino acid sequence having at least 85% identity to SEQ ID NO: 316. The expansin protein further comprises a signal peptide comprising SEQ ID NO: 352 at its amino terminus.

The fusion protein can comprise an expansin protein comprising an amino acid sequence having at least 90% identity to SEQ ID NO: 316. The expansin protein further comprises a signal peptide comprising SEQ ID NO: 352 at its amino terminus.

The fusion protein can comprise an expansin protein comprising an amino acid sequence having at least 95% identity to SEQ ID NO: 316. The expansin protein further comprises a signal peptide comprising SEQ ID NO: 352 at its amino terminus.

The fusion protein can comprise an expansin protein comprising an amino acid sequence having at least 98% identity to SEQ ID NO: 316. The expansin protein further comprises a signal peptide comprising SEQ ID NO: 352 at its amino terminus.

The fusion protein can comprise an expansin protein comprising an amino acid sequence having at least 99% identity to SEQ ID NO: 316. The expansin protein further comprises a signal peptide comprising SEQ ID NO: 352 at its amino terminus.

The fusion protein can comprise an expansin protein comprising an amino acid sequence having 100% identity to SEQ ID NO: 316. The expansin protein further comprises a signal peptide comprising SEQ ID NO: 352 at its amino terminus.

D. Methods for Making the Fusion Proteins

Any of the fusion proteins described herein can be made using standard cloning and molecular biology methods known in the art. For example, a gene encoding a protein or peptide of interest (e.g., an enzyme having ACC deaminase activity, a phospholipase, a lipase, a xylanase, a xylosidase, a lactonase, a chitosanase, a protease, a glucanase, an expansin protein, a phytase, the an phosphatase, a pectinase, or a mannanase) can be amplified by polymerase chain reaction (PCR) and ligated to DNA coding for any of the targeting sequences, exosporium proteins, or exosporium protein fragments described herein, to form a DNA molecule that encodes the fusion protein. The DNA molecule encoding the fusion protein can be cloned into any suitable vector, for example a plasmid vector. The vector suitably comprises a multiple cloning site into which the DNA molecule encoding the fusion protein can be easily inserted. The vector also suitably contains a selectable marker, such as an antibiotic resistance gene, such that bacteria transformed, transfected, or mated with the vector can be readily identified and isolated. Where the vector is a plasmid, the plasmid suitably also comprises an origin of replication. Alternatively, DNA coding for the fusion protein can be integrated into the chromosomal DNA of the *B. cereus* family member or spore-forming bacterium host.

E. Tags, Markers, and Linkers that can be Included in the Fusion Proteins

Any of the fusion proteins described herein can also comprise additional polypeptide sequences that are not part of the targeting sequence, exosporium protein, exosporium protein fragment, or the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase. For example, the fusion protein can include tags or markers to facilitate purification or visualization of the fusion protein (e.g., a polyhistidine tag or a fluorescent protein such as GFP or YFP) or visualization of recombinant *Bacillus cereus* family member spores expressing the fusion protein.

Expression of fusion proteins on the exosporium of a *Bacillus cereus* family member using the targeting sequences, exosporium proteins, and exosporium protein fragments described herein is enhanced due to a lack of secondary structure in the amino-termini of these sequences, which allows for native folding of the fused proteins and retention of activity. Proper folding can be further enhanced by the inclusion of a short amino acid linker between the targeting sequence, exosporium protein, exosporium protein fragment, spore coat protein, and the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

Thus, any of the fusion proteins described herein can comprise an amino acid linker between the targeting sequence, the exosporium protein, or the exosporium protein fragment and the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

The linker can comprise a polyalanine linker or a polyglycine linker. A linker comprising a mixture of both alanine and glycine residues can also be used.

For example, in a fusion protein where the targeting sequence comprises SEQ ID NO: 1, a fusion protein can have one of the following structures:

No linker: SEQ ID NO: 1-POI
Alanine Linker: SEQ ID NO: 1-$A_n$-POI
Glycine Linker: SEQ ID NO: 1-$G_n$-POI
Mixed Alanine and Glycine Linker: SEQ ID NO: 1-$(A/G)_n$-POI where $A_n$, $G_n$, and $(A/G)_n$ are any number of alanines, any number of glycines, or any number of a mixture of alanines and glycines, respectively. For example, n can be 1 to 25, and is preferably 6 to 10. Where the linker comprises a mixture of alanine and glycine residues, any combination of glycine and alanine residues can be used. In the above structures, "POI" stands for "protein of interest" and represents the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

Alternatively or in addition, the linker can comprise a protease recognition site. Inclusion of a protease recognition site allows for targeted removal, upon exposure to a protease that recognizes the protease recognition site, of the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

Where the fusion protein comprises both a linker and signal peptide, the linker would typically be amino-terminal to the signal peptide. For example, where the fusion protein comprises SEQ ID NO: 96, a polyalanine linker, the signal sequence of SEQ ID NO: 335, and the lichenase of SEQ ID NO: 295, these elements would typically be arranged in the following order within the fusion protein, going from the amino-terminus of the fusion protein to the carboxy-terminus:

SEQ ID NO: 96-$A_n$-SEQ ID NO: 335-SEQ ID NO: 295.

II. Recombinant *Bacillus cereus* Family Members Hosts for Expression of the Fusion Proteins The invention further relates to recombinant *Bacillus cereus* family members that express a fusion protein. The fusion protein can be any of the fusion proteins described in Section I above.

The recombinant *Bacillus cereus* family member can comprise any *Bacillus* species that is capable of producing an exosporium. For example, the recombinant *Bacillus cereus* family member can comprise *Bacillus anthracis, Bacillus cereus, Bacillus thuringiensis, Bacillus mycoides, Bacillus pseudomycoides, Bacillus samanii, Bacillus gaemokensis, Bacillus weihenstephensis, Bacillus toyoiensis*, or a combination of any thereof. The recombinant *Bacillus cereus* family member suitably comprises *Bacillus thuringiensis* or *Bacillus mycoides*.

To generate a recombinant *Bacillus cereus* family member expressing a fusion protein, any *Bacillus cereus* family member can be conjugated, transduced, or transformed with a vector encoding the fusion protein using standard methods known in the art (e.g., by electroporation). The bacteria can then be screened to identify transformants by any method known in the art. For example, where the vector includes an antibiotic resistance gene, the bacteria can be screened for antibiotic resistance. Alternatively, DNA encoding the fusion protein can be integrated into the chromosomal DNA of a *B. cereus* family member host. The recombinant *Bacillus cereus* family member can then exposed to conditions which will induce sporulation. Suitable conditions for inducing sporulation are known in the art. For example, the recombinant *Bacillus cereus* family member can be plated onto agar plates, and incubated at a temperature of about 30° C. for several days (e.g., 3 days).

Thus, the recombinant *Bacillus cereus* family member can be in the form of a spore.

Inactivated strains, non-toxic strains, or genetically manipulated strains of any of the above species can also suitably be used. For example, a *Bacillus thuringiensis* that lacks the Cry toxin can be used. Alternatively or in addition, once the recombinant *B. cereus* family member spores expressing the fusion protein have been generated, they can be inactivated to prevent further germination once in use. Any method for inactivating bacterial spores that is known in the art can be used. Suitable methods include, without limitation, heat treatment, gamma irradiation, x-ray irradiation, UV-A irradiation, UV-B irradiation, chemical treatment (e.g., treatment with glutaraldehyde, formaldehyde, hydrogen peroxide, acetic acid, bleach, or any combination thereof), or a combination thereof. Alternatively, spores derived from nontoxigenic strains, or genetically or physically inactivated strains, can be used.

Thus, the recombinant *Bacillus cereus* family member can be in the form of a spore, wherein the spore is inactivated.

The recombinant *Bacillus cereus* family member can coexpress two or more of any of the fusion proteins described herein. For example, the recombinant *Bacillus cereus* family member can coexpress at least one fusion protein that comprises a xyloglucanase together with a fusion protein that comprises a mannanase.

Many *Bacillus cereus* family member strains have inherent beneficial attributes. For example, some strains have plant-growth promoting effects. Other strains are endophytic. Some strains are both endophytic and have plant-growth promoting effects.

Thus, any of the recombinant *Bacillus cereus* family members described herein can comprise a plant-growth promoting strain of bacteria, an endophytic strain of bacteria, or a strain of bacteria that is both plant-growth promoting and endophytic.

The plant-growth promoting strain of bacteria can comprise a strain of bacteria that produces an insecticidal toxin (e.g., a Cry toxin), produces a fungicidal compound (e.g., a β-1,3-glucanase, a chitosanase, a lyticase, or a combination of any thereof), produces a nematocidal compound (e.g., a Cry toxin), produces a bacteriocidal compound, is resistant to one or more antibiotics, comprises one or more freely replicating plasmids, binds to plant roots, colonizes plant roots, forms biofilms, solubilizes nutrients, secretes organic acids, or any combination thereof.

For example, the recombinant *Bacillus cereus* family member can comprise: (a) *Bacillus mycoides* BT155 (NRRL No. B-50921), (b) *Bacillus mycoides* EE118 (NRRL No. B-50918), (c) *Bacillus mycoides* EE141 (NRRL No. B-50916), (d) *Bacillus mycoides* BT46-3 (NRRL No. B-50922), (e) *Bacillus cereus* family member EE128 (NRRL No. B-50917), (f) *Bacillus thuringiensis* BT013A (NRRL No. B-50924), (g) *Bacillus cereus* family member EE349 (NRRL No. B-50928), (h) *Bacillus cereus* family member EE-B00377 (NRRL B-67119), (i) *Bacillus pseudomycoides* EE-B00366 (NRRL B-67120), (j) *Bacillus mycoides* EE-B00363 (NRRL B-67121), (k) *Bacillus cereus* family member EE439 (NRRL B-50979); (l) *Bacillus thuringiensis* EE417 (NRRL B-50974); (m) *Bacillus cereus* EE444 (NRRL B-50977); (n) *Bacillus thuringiensis* EE319 (NRRL B-50983); (o) *Bacillus mycoides* EE116 (NRRL No. B-50919); or (p) *Bacillus thuringiensis* EE-B00184 (NRRL B-67122). For example, the recombinant *Bacillus cereus* family member can comprise *Bacillus thuringiensis* BT013A (NRRL No. B-50924) or *Bacillus cereus* family member EE349 (NRRL No. B-50928).

Each of the strains (a) through (g) and (o) was deposited with the United States Department of Agriculture (USDA) Agricultural Research Service (ARS), having the address 1815 North University Street, Peoria, Illinois 61604 U.S.A., on Mar. 10, 2014, and is identified by the NRRL deposit number provided in parentheses. *Bacillus thuringiensis* BT013A is also known as *Bacillus thuringiensis* 4Q7. Each of the strains (h) through (j) was deposited with the USDA ARS on Aug. 19, 2015, and is identified by the NRRL deposit number provided in parentheses. Each of the strains (k), (l), and (m) were deposited with the USDA ARS on Sep. 10, 2014, and is identified by the NRRL deposit number provided in parentheses. Strain (n) was deposited with the USDA ARS on Sep. 17, 2014, and is identified by the NRRL deposit number provided in parentheses. Strain (p) was deposited with the USDA ARS on Aug. 19, 2015, and is identified by the NRRL deposit number provided in parentheses. It is hereby certified that the deposits were made in compliance with the terms of the Budapest Treaty and that: (i) during the pendency of this application, access to the deposited organisms will be afforded to the Commissioner upon request; (ii) all restrictions upon availability to the public of the deposited materials will be irrevocably removed upon granting of the patent, subject to 37 C.F.R. § 1.808(b); (iii) the deposit will be maintained for a period of 30 years or 5 years after the last request or for the effective life of the patent, whichever is longer; and (iv) the deposit will be replaced if it should ever become non-viable.

These strains were isolated from the rhizospheres of various vigorous plants or from the inside of plants (for endophytic strains) and were identified by their 16S rRNA sequences (listed below in Table 18), and through biochemical assays. The strains were identified at least to their genus designation by means of conventional biochemistry and morphological indicators. Biochemical assays for confirmed Gram-positive strains such as *Bacillus* included growth on PEA medium and nutrient agar, microscopic examination, growth on 5% and 7.5% NaCl medium, growth at pH 5 and pH 9, growth at 42° C. and 50° C., the ability to produce acid upon fermentation with cellobiose, lactose, glycerol, glucose, sucrose, d-mannitol, and starch; fluorescent pigment production; gelatin hydrolysis; nitrate reduction; catalase production, starch hydrolysis; oxidase reaction, urease production and motility. Identification of these strains and demonstration of their plant-growth promoting effects and/or ability to grow endophytically are described further in the Examples hereinbelow.

TABLE 18

Partial 16S rRNA sequences for *Bacillus cereus* family members

| Strain | SEQ ID NO. for partial 16S ribosomal RNA sequence |
|---|---|
| *Bacillus mycoides* EE118 | 200 |
| *Bacillus mycoides* EE141 | 201 |
| *Bacillus mycoides* BT46-3 | 202 |
| *Bacillus cereus* family member EE128 | 203 |
| *Bacillus cereus* family member EE349 | 204 |
| *Bacillus mycoides* BT155 | 205 |
| *Bacillus cereus* family member EE439 | 206 |
| *Bacillus thuringiensis* EE417 | 207 |
| *Bacillus cereus* EE444 | 208 |
| *Bacillus thuringiensis* EE319 | 209 |
| *Bacillus thuringiensis* EE-B00184 | 210 |
| *Bacillus mycoides* EE-B00363 | 211 |
| *Bacillus pseudomycoides* EE-B00366 | 212 |
| *Bacillus cereus* family member EE-B00377 | 213 |
| *Bacillus thuringiensis* BT013A | 214 |
| *Bacillus mycoides* EE116 | 215 |

The recombinant *Bacillus cereus* family member can comprises an endophytic strain of bacteria. For example, the endophytic strain of bacteria can comprise *Bacillus cereus* family member EE349, *Bacillus cereus* family member EE439, *Bacillus thuringiensis* EE417, *Bacillus cereus* EE444, or *Bacillus thuringiensis* EE319, *Bacillus thuringiensis* EE-B00184, *Bacillus cereus* family member EE-B00377; *Bacillus pseudomycoides* EE-B00366; or *Bacillus mycoides* EE-B00363.

*Bacillus cereus* family member EE349 is also a plant growth promoting strain of bacteria and is described above. As discussed further in the Examples below, *Bacillus cereus* family member EE349 has also been found to be endophytic.

The recombinant *Bacillus cereus* family member can comprise an inactivating mutation in its BclA gene, its CotE gene, or its CotO gene (e.g., a knock-out of the BclA gene, CotE gene, or CotO gene). For example, the recombinant *Bacillus cereus* family member can comprise an inactivating mutation in its BclA gene (e.g., a knock-out of the BclA gene). It has been found that expression of fusion proteins in a recombinant *Bacillus cereus* family member having such a mutation results in increased expression levels of the fusion protein.

As described further below in Section IV, the recombinant *Bacillus cereus* family member can comprise a mutation or other modification that allows for collection of exosporium fragments comprising the fusion proteins from spores of the recombinant *Bacillus cereus* family member.

III. Promoters for Expression of Fusion Proteins in Recombinant *Bacillus cereus* Family Members The DNA encoding the fusion proteins used in the recombinant *Bacillus cereus* family members, exosporium fragments, formulations, plant seeds, and methods, described herein is suitably under the control of a sporulation promoter which will cause expression of the fusion protein on the exosporium of a *B. cereus* family member endospore (e.g., a native bclA promoter from a *B. cereus* family member).

Thus, any of the fusion proteins described above in Section I can be expressed in the recombinant *Bacillus cereus* family member under the control of a sporulation promoter that is native to the targeting sequence, exosporium protein, or exosporium protein fragment of the fusion protein, or a portion of such a promoter.

Any of the fusion proteins can be expressed under the control of a high-expression sporulation promoter.

The high-expression sporulation promoter can comprise a sigma-K sporulation-specific polymerase promoter sequence.

For ease of reference, illustrative nucleotide sequences for promoters that can be used to express any of the fusion proteins in a recombinant *Bacillus cereus* family member are provided in Table 19 below, together with their SEQ ID NOs. Table 19 also provides illustrative minimal promoter sequences for many of the promoters. In Table 19, sigma-K sporulation-specific polymerase promoter sequences in the promoters are indicated by bold and underlined text. Several of the sequences have multiple sigma K sequences that overlap with one another. The overlaps are indicated by double underlining in the table. The promoter sequences are immediately upstream of the start codon for each of the indicated genes. In other words, in the sequences shown in Table 19 below, the last nucleotide of the promoter sequence immediately precedes the first nucleotide of the start codon for the coding region of the gene encoding the indicated protein.

TABLE 19

Promoter Sequences for Expression of Fusion Proteins in Recombinant *Bacillus cereus* family members

| Promoter (SEQ ID NO) | Promoter Sequence |
|---|---|
| ExsY promoter (*B. cereus* F837/76) (SEQ ID NO: 37) | TTTCTTAATCCTTTACCCTTTACTTTTGTAAAAGTTGATACACTT CCATCCGGCTCTGTAATTTCTAATTCATCAATAAATGGTCTTCG CAAAAAGCCTGTAATTTTATCATAAACAATTAAACGAGTGAGC CTAAAAGCAGCTAACGCGAAAATAAAAAATAAAAGCCAGCTT GTAAACAGCATAATTCCACCTTCCCTTATCCTCTTTCGCCTATT TAAAAAAAGGTCTTGAGATTGTGACCAAATCTCCTCAACTCCA ATATCTTATTAATGTAAATACAAACAAGAAGATAAGGA |
| ExsY minimal promoter (*B. cereus* F837/76) (SEQ ID NO: 38) | ACCAAATCTCCTCAACTCCAATATCTTATTAATGTAAATACAA ACAAGAAGATAAGGA |
| ExsFA/BxpB promoter (*B. anthracis* Sterne) (SEQ ID NO: 39) | ACCACCTACCGACGATCCAATCTGTACATTCCTAGCTGTACCA AATGCAAGATTAATATCGACTAACACTTGTCTTACTGTTGATTT AAGTTGCTTCTGTGCGATTCAATGCTTGCGTGATGTTACGATTT AAAACTAAATAATGAGCTAAGCATGGATTGGGTGGCAGAATT ATCTGCCACCCAATCCATGCTTAACGAGTATTATTATGTAAATT TCTTAAAATTGGGAACTTGTCTAGAACATAGAACCTGTCCTTTT CATTAACTGAAAGTAGAAACAGATAAAGGAGTGAAAAAC |
| ExsFA/BxpB minimal promoter (*B. anthracis* Sterne) (SEQ ID NO: 40) | ACATAGAACCTGTCCTTTTCATTAACTGAAAGTAGAAACAGAT AAAGGAGTGAAAAAC |
| CotY/CotZ promoter (*B. anthracis* Sterne) (SEQ ID NO: 41) | TAGAAGAAGAACGCCGACTACTTTATGTCGCAATTACACGGGC GAAAGAAGAACTTTACATTTCCTCTCCGCAATTTTTTAGAGGA AAAAAATTAGATATATCTCGTTTTTTATACACTGTGCGAAAAG ATTTACCTGAAAAGACATCCACTAAATAAGGATGTCTTTTTTA TATTGTATTATGTACATCCCTACTATATAAATTCCCTGCTTTTAT CGTAAGAATTAACGTAATATCAACCATATCCCGTTCATATTGT AGTAGTGTATGTCAGAACTCACGAGAAGGAGTGAACATA |
| CotY/CotZ minimal promoter (*B. anthracis* Sterne) (SEQ ID NO: 42) | TCAACCATATCCCGTTCATATTGTAGTAGTGTATGTCAGAACT CACGAGAAGGAGTGAACATA |
| CotO promoter (*B. cereus*) (SEQ ID NO: 123) | TAACTCAATCTTAAGAGAAATTGAGGAGCGCGCACCACTTCGT CGTACAACAACGCAAGAAGAAGTTGGGGATACAGCAGTATTCT TATTCAGTGATTTAGCACGCGGCGTAACAGGAGAAAACATTCA CGTTGATTCAGGGTATCATATCTTAGGATAAATATAATATTAA TTTTAAAGGACAATCTCTACATGTTGAGATTGTCCTTTTTATTT GTTCTTAGAAAGAACGATTTTTAACGAAAGTTCTTACCACGTTA TGAATATAAGTATAATAGTACACGATTTATTCAGCTACGT |

TABLE 19 -continued

Promoter Sequences for Expression of Fusion Proteins in Recombinant *Bacillus cereus* family members

| Promoter (SEQ ID NO) | Promoter Sequence |
|---|---|
| CotO minimal promoter (*B. cereus*) (SEQ ID NO: 124) | ACGTTGATTCAGGGTATCATATCTTAGGATAAATATAATATTA<br>ATTTTAAAGGACAATCTCTACATGTTGAGATTGTCCTTTTTATT<br>TGTTCTTAGAAAGAACGATTTTTAACGAAAGTTCTTACCACGTT<br>ATGAATATAAGTATAATAGTACACGATTTATTCAGCTACGT |
| ExsFB promoter (*B. cereus* F837/76) (SEQ ID NO: 125) | CATAAAAATCTACTTTTCTTGTCAAAGAGTATGCTTATATGCGT<br>GCTCTTTTTATTTGGTTTTCTTTCATTTCTAAATAACATTTTCAA<br>CTCTATTCATACTATTCTTTCAACTTTAGGTTACAAACTATTTCT<br>GTAAGCGTAGTGTTTCTTTTGTACTATAGGCAGTTAGTTTTATC<br>CATAACAGTACACCTCTGCACTATTCACTATAAATTTTCATATA<br>TTATATTGTGCTTGTCCAAAACATGTGGTTATTACTCACGCGAT<br>CTAAATGAAAGAAAGGAGTGAAAAT |
| ExsFB minimal promoter (*B. cereus* F837/76) (SEQ ID NO: 126) | ACTATTCACTATAAATTTTCATATATTATATTGTGCTTGTCCAA<br>AACATGTGGTTATTACTCACGCGATCTAAATGAAAGAAAGGAG<br>TGAAAAT |
| InhA1 promoter (*B. thuringiensis* serovar kurstaki str. HD-1) (SEQ ID NO: 127) | AATACATGATAATGAAATCCGATTTTGTGTTTTATATAGTGAAT<br>TATCAAATATTGTGTAGATGAAACAAAGATAAAATCCCCATTA<br>AACTCCCTCTATGGAAATTATAAATTGTTCGATAAAAACTTTCA<br>ATATTTTCAGAAAACATTGTTGAATTGTGATATATTCGTATGCT<br>AACTATGAAATTTTTACAAATATATTAAAAACATTACATAATA<br>TGACTAAATATTGAAAAAATATTGAATTTTTAATAAAATTTAA<br>TTTGTAATACATATTATTTATTAGGGGAGGAAATAAGGG |
| InhA1 minimal promoter (*B. thuringiensis* serovar kurstaki str. HD-1) (SEQ ID NO: 128) | AAAATTTAATTTGTAATACATATTATTTATTAGGGGAGGAAAT<br>AAGGG |
| InhA2 promoter (*B. mycoides* strain 219298) (SEQ ID NO: 129) | AATTGTGCATATTGTCTTTTAAATTTTCTATCTAAGTTATTTAAT<br>ATATAATAAATAACTCTTTTTTGTGAGTTTTTTTGATACGAGGT<br>AAATAATCAGTACAGGGTCTGACCAGAGGACTGGAGGGCATG<br>ATTCTATAAGGGAATATTTACTATTCCATGATTATAGAACTATG<br>TCTTTTTTATTGTATATAGAAGGGGGGATAGGTCTATATTATA<br>GAACTTATATATATTGTGCATTCCATATTATCAATTATCTAAAT<br>TTTAAGTCTTGTTACAATTAATAAGGGAGGAAATAGTA |
| InhA2 minimal promoter (*B. mycoides* strain 219298) (SEQ ID NO: 130) | ACTTATATATATTGTGCATTCCATATTATCAATTATCTAAATTT<br>TAAGTCTTGTTACAATTAATAAGGGAGGAAATAGTA |
| ExsJ promoter (*B. thuringiensis* serovar kurstaki) (SEQ ID NO: 131) | AATGACGTTTTCAAGTTTGATTATCATTCATGTTTCCTATTTTAA<br>GAGAAACATATAACTCAACTACTTTTTTCAATGGCATCTTTTA<br>TAGTACTTAGAATAGGAAAACACTCAACTATAAGAAAAGTAA<br>GGAGGAAATAA |
| ExsJ minimal promoter (*B. thuringiensis* serovar kurstaki) (SEQ ID NO: 132) | ACTACTTTTTTCAATGGCATCTTTTATAGTACTTAGAATAGGA<br>AAACACTCAACTATAAGAAAAGTAAGGAGGAAATAA |
| ExsH promoter (*B. cereus* F837/76) (SEQ ID NO: 133) | ATATGCTAATGCTTAGTTTTTATACTCAAGTTAAAATGTGCTTT<br>TGGACCTAAGAGATAAACGTGGAAAAATAAAATAAACTCTTA<br>AGTTTAGGTGTTTAATCTAAGCAGTCAATTATTAAAAACATAT<br>AATTAATATGTGAGTCATGAACATAATTAAATAATGTTTTCAA<br>GTTTAATTATCGTTCATGTTTCCTATTTTAAGCAGAACAAATAA<br>CTCAATTACTTTTTTCGATTGGATCTTTTTTAACTCTTATAATAG<br>GAAAACACTCAACTATAAAAATAAGTAAGGAGGAAATAA |
| ExsH minimal promoter (*B. cereus* F837/76) (SEQ ID NO: 134) | AATATGTGAGTCATGAACATAATTAAATAATGTTTTCAAGTTT<br>AATTATCGTTCATGTTTCCTATTTTAAGCAGAACAAATAACTCA<br>ATTACTTTTTTCGATTGGATCTTTTTTAACTCTTATAATAGGAA<br>AACACTCAACTATAAAAATAAGTAAGGAGGAAATAA |
| YjcA promoter (*B. thuringiensis* serovar kurstaki str. H73) (SEQ ID NO: 135) | TATAAAATAAAAGGGCGTGTATTTGCTACTGATGCAGTATTGT<br>GTGCGCCTAAAAATGGAATTTCACAACCAGATCCACATGTTGT<br>TGTAGAACAATCTTGTAATTCATTGATGAATTTTACAACGTCAA<br>CTACACAATGAGAAGAGCCATGGTGTTTATTTTCGTTACAACTC<br>ATTAATGTCACTCCTTATCTTCTTGTTTGTATTTACATTAATAA<br>GATATTGGAGTTGAGGAGATTTGGTCACAATCTCAAGACCTTT<br>TTTTTAAATAGGCGAAAGAGGATAAGGGAAGGTGGAATT |

TABLE 19 -continued

Promoter Sequences for Expression of Fusion Proteins in Recombinant *Bacillus cereus* family members

| Promoter (SEQ ID NO) | Promoter Sequence |
|---|---|
| YjcA minimal promoter (*B. thuringiensis* serovar kurstaki str. HD73) (SEQ ID NO: 136) | TCTTGTTTGTATTTACATTAATAAGATATTGGAGTTGAGGAGAT TTGGTCACAATCTCAAGACCTTTTTTTTAAATAGGCGAAAGAG GATAAGGGAAGGTGGAATT |
| YjcB promoter (*B. thuringiensis* serovar kurstaki str. HD73) (SEQ ID NO: 137) | ATCAACTTTTACAAAAGTAAAGGGTAAAGGATTAAGAAAGTG GATTGGCGAATTATTAAGCTGTTATTGGTGTACAGGTGTATGG GTTAGTGCTTTTTTATTAGTTTTATATAATTGGATTCCGATCGTT GCAGAGCCGTTACTTGCATTATTAGCTATTGCAGGAGCAGCAG CAATCATTGAAACGATTACAGGATATTTTATGGGAGAATAAT ATATTTTCATAATACGAGAAAAAGCGGAGTTTAAAAGAATGAG GGAACGGAAATAAAGAGTTGTTCATATAGTAAATAGACAGAA |
| YjcB minimal promoter (*B. thuringiensis* serovar kurstaki str. HD73) (SEQ ID NO: 138) | ACGGAAATAAAGAGTTGTTCATATAGTAAATAGACAGAA |
| BclC promoter (*B. anthracis* Sterne) (SEQ ID NO: 139) | TGAAGTATCTAGAGCTAATTTACGCAAAGGAATCTCAGGACAA CACTTTCGCAACACCTATATTTTAAATTTAATAAAAAAAGAGA CTCCGGAGTCAGAAATTATAAAGCTAGCTGGGTTCAAATCAAA AATTTCACTAAAACGATATTATCAATACGCAGAAAATGGAAAA AACGCCTTATCATAAGGCGTTTTTTCCATTTTTTCTTCAAACAA ACGATTTTACTATGACCATTTAACTAATTTTTGCATCTACTATG ATGAGTTTCATTCACATTCTCATTAGAAAGGAGAGATTTA |
| BclC minimal promoter (*B. anthracis* Sterne) (SEQ ID NO: 140) | ACCATTTAACTAATTTTTGCATCTACTATGATGAGTTTCATTCA CATTCTCATTAGAAAGGAGAGATTTA |
| AcpC promoter (*B. cereus* F837/76) (SEQ ID NO: 141) | GACTATGTTTATTCAGGATAAAATATAGCACTACACTCTCTCCT CTTATTATGTAGCATCTCTCTAATCCATCATTTGTTTCATTTAGT TAAAATTGTAAATAAAATCACATGATTTGTCAATTATAATTGTC ATTTCGACAATTAAACTTGTCAAAATAATTCTCATCATTTTTTC TCATCTTTCTAATATAGGACATACTACTATATATACAAAAGAC AATATGCAAATGTTCATACAAAAAATATTATTTTTCGATATAT AATATTAACTGATTTTCTAACATCAAGGAGGGTACAT |
| AcpC minimal promoter (*B. cereus* F837/76) (SEQ ID NO: 142) | AGACAATATGCAAATGTTCATACAAAAAATATTATTTTTCGAT ATATAATATTAACTGATTTTCTAACATCAAGGAGGGTACAT |
| InhA3 promoter (*B. thuringiensis* serovar kurstaki str. HD73) (SEQ ID NO: 143) | ATAGTGAGTAATATGGTAATCCATAGATTAAATAGTATAGAA AATATTTAATTCTTATTTTTATTAAAAAAGCATGAATCCCAGAT TTACTGGGTTTTGATTGTAACTAAGAACATATAAAAGTTCACT GTTATTTATAGGAGAGTCTGTTTGTTTTTATATCTTATGTATTT CACCCTGCATAAAAAAATATTTCTAACATTTTATTTGTTGAAA AATATTGAATATTCGTATTATAACGAATATTATGTTGTTATCGG CAAAAAACGATAATTTGCAGACACTGGGGAGGAAATACA |
| InhA3 minimal promoter (*B. thuringiensis* serovar kurstaki str. HD73) (SEQ ID NO: 144) | TCTTATGTATTTCACCCTGCATAAAAAAATATTTCTAACATTT TATTTGTTGAAAAATATTGAATATTCGTATTATAACGAATATTA TGTTGTTATCGGCAAAAAACGATAATTTGCAGACACTGGGGAG GAAATACA |
| Alanine racemase 1 promoter (*B. cereus* F837/76) (SEQ ID NO: 145) | CTTCGTCAGCAATAAGTGTGAGCGGAGAATTGGTTGATCTTGG CTTTACAATTGGAGCATTGACGAAAGACTCTTTAACGTGGTCG CATAACGGAGTAGAATATATGCTCGTGTCTAAAGGTTTAGAGC CGAAGGAGCTATTAATGGTTGCTCGTTCAGTTACAGAGAAGCA AGTGAAGTAAACTTCTTAGACGTGGTGATATATGTGCACCACG TCTTTTCTTAGTTTGAAGGGTGGATTTCATAAAAGAAGCATAT AAAAGAATAAGCTTCGCATATCGTGTATAAGGAAGTGTATTT |
| Alanine racemase 1 minimal promoter (*B. cereus* F837/76) (SEQ ID NO: 146) | ATAAAAGAATAAGCTTCGCATATCGTGTATAAGGAAGTGTAT TT |
| Alanine racemase 2 promoter (*B. thuringiensis* serovar kurstaki str. HD73) (SEQ ID NO: 147) | CATTTCAAATAATGAACGCTTCGATTGAATCGGAGCTATTTTCA AATCAATTTCAGTATATTGATCCAGCATTTGAATAGAAGTATC AACAGCAACTTTAAGTTGATGCAATGCAGATTGTACAAACATT GTAATTCTCCTCTTCTCCGTATATAATAGTTTCTTGAGGGTATT ATATCATGCTCAAAATTCCGAAAATTCTAGTAGTTTGACTAGCC ATATTGAAAAGTATTTATATTGTAAAAGGTCATATGAAACGTG AAATAGAATGGAATGCAATTATTGAGTTAGGAGTTAGACCA |

TABLE 19 -continued

Promoter Sequences for Expression of Fusion Proteins in Recombinant *Bacillus cereus* family members

| Promoter (SEQ ID NO) | Promoter Sequence |
|---|---|
| Alanine racemase 2 minimal promoter (*B. thuringiensis* serovar kurstaki str. HD73) (SEQ ID NO: 148) | TTATATTGTAAAAGGTCATATGAAACGTGAAATAGAATGGAA TGCAATTATTGAGTTAGGAGTTAGACCA |
| BclA promoter (*B. cereus* F837/76) (SEQ ID NO: 149) | ATCGATGGAACCTGTATCAACCACTATAATTTCATCCACAATTT TTTCAACTGAGTCTAAACAACGGGCTATTGTCTTCTCCTCATCT CGAACAATCATACATAAACTAATTGTAATTCCTTGCTTGTTCA ACATAATCACCCTCTTCCAAATCAATCATATGTTATACATATA CTAAACTTTCCATTTTTTTAAATTGTTCAAGTAGTTTAAGATTT CTTTTCAATAATTCAAATGTCCGTGTCATTTTCTTTCGGTTTTGC ATCTACTATATAATGAACGCTTTATGGAGGTGAATTT |
| BclA minimal promoter (*B. cereus* F837/76) (SEQ ID NO: 150) | AATCAATCATATGTTATACATATACTAAACTTTCCATTTTTTT AAATTGTTCAAGTAGTTTAAGATTTCTTTTCAATAATTCAAATG TCCGTGTCATTTTCTTTCGGTTTTGCATCTACTATATAATGAAC GCTTTATGGAGGTGAATTT |
| BclB promoter (*B. thuringiensis* serovar konkukian str. 97-27) (SEQ ID NO: 151) | GACCTGTAAGTCTGTAGGGAAGAATAATTTCAAGAGCCAGTGA TAATAGATTTTTTTGTTTTTTCATTCTTATCTTGAATATAAATCA CCTCATCTTTTAATTAGAACGTAACCAATTTAGTATTTTGAAA TAGAGCTATCATTTTATAAATGAATACTACTAGTTATAGAAA CGGCAAAAAGTTTAATATATGTAAAAATCATTTGGATATGAAA AAAGTAGCCATAGATTTTTTCGAAATGATAAATGTTTTATTTT GTTAATTAGGAAACAAAAATGTGGAATGAGGGGGATTTAA |
| BclB minimal promoter (*B. thuringiensis* serovar konkukian str. 97-27) (SEQ ID NO: 152) | ATATGAAAAAGTAGCCATAGATTTTTTCGAAATGATAAATGT TTTATTTTGTTAATTAGGAAACAAAAATGTGGAATGAGGGGGA TTTAA |
| BxpA promoter (*B. anthracis* str. Sterne) (SEQ ID NO: 153) | TTTTCATCTGCTACATCGTGAAGTAATGCTGCCATTTCAATTAT AAAACGATTTCCTCCTTCTTGCTCGGATAAAGAAATCGCCAGTT TATGTACACGCTCAATATGATACCAATCATGCCCACTGGCATC TTTTTCTAAAATATGTTTTACAAAAGTAATTGTTTTTTCTATCTT TTCTTGTTTTGTCATTTTATCTTCACCCAGTTACTTATTGTAACA CGCCCGCATTTTTTCATCACATATTTTCTTGTCCGCCCATACA CTAGGTGGTAGGCATCATCATGAAGGAGGAATAGAT |
| BxpA minimal promoter (*B. anthracis* str. Sterne) (SEQ ID NO: 154) | ACATATTTTCTTGTCCGCCCATACACTAGGTGGTAGGCATCAT CATGAAGGAGGAATAGAT |
| BclE promoter (*B. anthracis* ΔSterne) (SEQ ID NO: 155) | GGTGACGACAACATATACAAGAGGCACTCCTGCTGGTACTGTA ACAGGAACAAATATGGGGCAAAGTGTAAATACATCGGGTATA GCACAAGCTGTCCCGAATACAGATAATATGGATTCAACGGCG GGACTCCCTTAAGAAATTAGGGGAGTCTTTATTTGGAAAAAGA GCTTATGTTACATAAAAACAGGAGTAATTGTTTTAAAAGTAGT ATTGGTGACGTTGTTAGAAAATACAATTTAAGTAGAAGGTGCG TTTTTATATGAAATATATTTTATAGCTGTACTTTACCTTTCAAG |
| BclE minimal promoter (*B. anthracis* ΔSterne) (SEQ ID NO: 156) | ACAAGCTGTCCCGAATACAGATAATATGGATTCAACGGCGGG ACTCCCTTAAGAAATTAGGGGAGTCTTTATTTGGAAAAAGAGC TTATGTTACATAAAAACAGGAGTAATTGTTTTAAAAGTAGTAT TGGTGACGTTGTTAGAAAATACAATTTAAGTAGAAGGTGCGTT TTTATATGAAATATATTTTATAGCTGTACTTTACCTTTCAAG |
| BetA promoter (*B. anthracis* Sterne) (SEQ ID NO: 157) | ATTTATTTCATTCAATTTTTCCTATTTAGTACCTACCGCACTCAC AAAAAGCACCTCTCATTAATTTATATTATAGTCATTGAAATCTA ATTTAATGAAATCATCATACTATATGTTTTATAAGAAGTAAAG GTACCATACTTAATTAATACATATCTATACACTTCAATATCAC AGCATGCAGTTGAATTATATCCAACTTTCATTTCAAATTAAATA AGTGCCTCCGCTATTGTGAATGTCATTTACTCTCCCTACTACAT TTAATAATTATGACAAGCAATCATAGGAGGTTACTAC |
| BetA minimal promoter (*B. anthracis* Sterne) (SEQ ID NO: 158) | TAAGAAGTAAAGGTACCATACTTAATTAATACATATCTATACA CTTCAATATCACAGCATGCAGTTGAATTATATCCAACTTTCATT TCAAATTAAATAAGTGCCTCCGCTATTGTGAATGTCATTTACTC TCCCTACTACATTTAATAATTATGACAAGCAATCATAGGAGGT TACTAC |

TABLE 19 -continued

Promoter Sequences for Expression of Fusion Proteins in Recombinant *Bacillus cereus* family members

| Promoter (SEQ ID NO) | Promoter Sequence |
|---|---|
| CotE promoter (*B. cereus* AH820) (SEQ ID NO: 159) | AGTTGTACAAGAATTTAAATCTTCACAAACATATGTAAATGAC TTACTACAGCTAGTTGCAAGTACGATTTCTAACAACGTAACAG ATGAAATATTAATTTCAACTAATGGCGATGTATTGAAGGGTGA AACGGGCGCAGCGGTAGAAAGTAAAAAAGGAAATTGTGGTTG TTAAAGAGATGTCGAAATGACATCTCTTTTTTTAGTGGATTAAA CGTAAGTTCTTCTCAAAAAAAGAATGACACATTCCGCTATTGT CACGCATATGATTAAGTGAATAGTGATTGAGGAGGGTTACGA |
| CotE minimal promoter (*B. cereus* AH820) (SEQ ID NO: 160) | ACATTCCGCTATTGTCACGCATATGATTAAGTGAATAGTGATT GAGGAGGGTTACGA |
| ExsA promoter (*B. cereus* strain ATCC 10876) (SEQ ID NO: 161) | AACGTTATTAGCGTAGACAAACAAGTAACGGCAGAAGCAGTTC TTGCATTAAATCGTATGTTAGAGCGTGTGTAAAGCAACGGTAT TCCCGTTGCTTTTTTTCATACATATAATCATAACGAGAACGAA ATGGGCATACATTGTTTTGAAGAAATCATTGTGGTTCTTTATG CTTATTCCACTTCGAATGATATTGAAAATCGAAGAAGTGATAA AAGTAAAAAGAAGTTAATGTTATTTAGAAAGAGTTACTTCATG AGATTTGTTACTTATAGATAAGTTATACAGGAGGGGGAAAAT |
| ExsA minimal promoter (*B. cereus* strain ATCC 10876) (SEQ ID NO: 162) | TCATGAGATTTGTTACTTATAGATAAGTTATACAGGAGGGGA AAAT |
| ExsK promoter (*B. thuringiensis* serovar konkukian str. 97-27) (SEQ ID NO: 163) | AAGCCGCGGTCAATGCTGTATATGCAAATAAGATTGCAGCTTT ACCTGAAGAAGAGCGTGATAGCTTCATTGCTGAAAAACGAGA AGAGTATAAGAAAGATATTGATATTTACCATTTAGCATCAGAG ATGGTCATTGATGGTATTGTTCATCCAAACAATTTAAGAGAAG AGTTAAAAGGACGATTCGAAATGTATATGAGTAAATATCAAGT ATTTACGGATCGTAAACATCCTGTTTATCCAGTTTAAAAGCCC TATTTAGGGCTTTCTTGCTCAAAAAGTTAAGGAGGGGAAAACA |
| ExsK minimal promoter (*B. thuringiensis* serovar konkukian str. 97-27) (SEQ ID NO: 164) | TCAAGTATTTACGGATCGTAAACATCCTGTTTATCCAGTTTAA AAGCCCTATTTAGGGCTTTCTTGCTCAAAAAGTTAAGGAGGGG AAAACA |
| ExsB promoter (*B. cereus* F837/76) (SEQ ID NO: 165) | AGGATTTCAGTGGGACGCCTCCTCTCTTCTTACATTAAATTAAT CATACTATAAAATGAAAGAAATGAAATGAAAAATAGCAGGAA AATCAGAAATTTTTTCTGGTAGTATACAATATGTTACAATAAG CTTTGTCAATGAAAGAAGGAATTCCGTGCAATGCACGGGAGAG GTTCGCGAACTCCCTCTATAAAAACTATGGAAACAACAATAT CTTTAGGTATTGTTTTGTTTTTTTATTGTGACAGTTCAAGAACG TTCTTTCTTCTTATTCGTAGTAGAGAAGGAGAATGAGTGAA |
| ExsB minimal promoter (*B. cereus* F837/76) (SEQ ID NO: 166) | ACTATGGAAACAACAATATCTTTAGGTATTGTTTTGTTTTTTA TTGTGACAGTTCAAGAACGTTCTTTCTTCTTATTCGTAGTAGAG AAGGAGAATGAGTGAA |
| YabG promoter (*B. cereus* AH820) (SEQ ID NO: 167) | TTTTGCACAACGCCGTAAAACTTTAATGAATAATTTATCAAAT AATTTAAATGGTTTCCCGAAAGATAAAGAGCTGTTGGATCGAA TTTTAACAGAAGTAGGAATTGATCCAAAACGAAGAGGCGAAA CGCTATCTATCGAAGAGTTTGCGACATTAAGTAATGCATTAGTT CTTCATAAGTTATCATAAGAATACAAAAGGGACAGTTCAATTT GAACTGTCCCTTTTGTCACCTTTCTCCTCCTAAATTCATACTTT AAAAACAGGTAAGATGGCCTAACGAGTTTGGAGGTAGGAGA |
| YabG minimal promoter (*B. cereus* AH820) (SEQ ID NO: 168) | TCTCCTCCTAAATTCATACTTTAAAAACAGGTAAGATGGCCTA ACGAGTTTGGAGGTAGGAGA |
| Tgl promoter (*B. thuringiensis* serovar konkukian str. 97-27) (SEQ ID NO: 169) | GGAAACAGAAGTCATCCCATTTGAAAATGCAGCAGGTCGTATT ATAGCTGATTTCGTTATGGTTTATCCGCCAGGGATTCCAATCTT TACTCCGGGGAAATTATTACACAAGACAACTTAGAGTATATT CGTAAAAACTTAGAAGCAGGTTTACCTGTACAAGGTCCTGAAG ATATGACATTACAAACATTACGCGTGATCAAAGAGTACAAGCC TATCAGTTGATAGGCTTTTTTCACCCTTTTTCCCTTTTCTCATA CGATATTATGTAATGTAACGTATAGGTGGGGATACTACT |
| Tgl minimal promoter (*B. thuringiensis* serovar konkukian str. 97-27) (SEQ ID NO: 170) | ACCCTTTTTCCCTTTTCTCATACGATATTATGTAATGTAACGTA TAGGTGGGGATACTACT |

TABLE 19 -continued

Promoter Sequences for Expression of Fusion Proteins in Recombinant *Bacillus cereus* family members

| Promoter (SEQ ID NO) | Promoter Sequence |
|---|---|
| Superoxide dismutase (SODA1) promoter (*B. cereus* F837/76) (SEQ ID NO: 171) | ATTGTGGACCCTTAGCTCAGCTGGTTAGAGCAGACGGCTCATA ACCGTCCGGTCGTAGGTTCGAGTCCTACAGGGTCCATATCCATT TCACATGTTTATTATGTCGGCAGGAAGCTTCCTTGTAGAAGGG AGCTTTTTTTATGAAATATATGAGCATTTTAATTGAAATGAAGT GGGAATTTTGCTACTTTAATGATAGCAAGACAATGTGATTTATT TGTTTGCACCCTATGGCAATTAGGGTAGAATGAAGTTGTATGT CACTTAAGTGGCAATACATAAACTGGGAGGAATATAACA |
| Superoxide dismutase (SODA1) minimal promoter (*B. cereus* F837/76) (SEQ ID NO: 172) | ACTTAAGTGGCAATACATAAACTGGGAGGAATATAACA |
| Superoxide dismutase (SODA2) promoter (*B. cereus* AH820) (SEQ ID NO: 173) | AATATAACAGAAAATTCTGATGTTTTTTCAAATCCTATAATAAG GAGTGTTCCGTATGATGCCTTTATATTTTCCGGAAGATAAAAC AGAATATATTATTCCAGGGATTGTTTGTGTTCTATTTATCATCG GTGCGATTGCTACGTGGCGTATGTTCATTCGTGTATCAAAACG AGAAGCAGAGCGATTACAGAAAGTTGAAGAAAAGCTGTTAGC TGAAAAGAAACAGTAACTCATTTTTGTATGTTTCCCTCTATGCT CGGACAATCTAAGGGCAGAATGTATTTTGGAGGGAATGAA |
| Superoxide dismutase (SODA2) minimal promoter (*B. cereus* AH820) (SEQ ID NO: 174) | TCCGGAAGATAAAACAGAATATATTATTCCAGGGATTGTTTGT GTTCTATTTATCATCGGTGCGATTGCTACGTGGCGTATGTTCAT TCGTGTATCAAAACGAGAAGCAGAGCGATTACAGAAAGTTGA AGAAAAGCTGTTAGCTGAAAAGAAACAGTAACTCATTTTTGTA TGTTTCCCTCTATGCTCGGACAATCTAAGGGCAGAATGTATTTT GGAGGGAATGAA |
| BclA promoter (*B. anthracis* Sterne) (SEQ ID NO: 175) | TAATCACCCTCTTCCAAATCAATCATATGTTATACATATACTA AACTTTCCATTTTTTTAAATTGTTCAAGTAGTTTAAGATTTCTT TTCAATAATTCAAATGTCCGTGTCATTTTCTTTCGGTTTTGCAT CTACTATATAATGAACGCTTTATGGAGGTGAATTT |
| BAS1882 promoter (*B. anthracis* Sterne) (SEQ ID NO: 176) | AATTACATAACAAGAACTACATTAGGGAGCAAGCAGTCTAGCG AAAGCTAACTGCTTTTTTATTAAATAACTATTTTATTAAATTTC ATATATACAATCGCTTGTCCATTTCATTTGGCTCTACCCACGCA TTTACTATTAGTAATATGAATTTTTCAGAGGTGGATTTTATT |
| Gene 3572 promoter (*B. weihenstephensis* KBAB 4) (SEQ ID NO: 177) | CTATGATTTAAGATACACAATAGCAAAAGAGAAACATATTAT ATAACGATAAATGAAACTTATGTATATGTATGGTAACTGTATA TATTACTACAATACAGTATACTCATAGGAGGTAGGT |
| YVTN β-propeller protein promoter (*B. weihenstephensis* KBAB 4) (SEQ ID NO: 178) | GGTAGGTAGATTTGAAATATGATGAAGAAAAGGAATAACTAA AAGGAGTCGATATCCGACTCCTTTTAGTTATAAATAATGTGGA ATTAGAGTATAATTTTATATAGGTATATTGTATTAGATGAACGC TTTATCCTTTAATTGTGATTAATGATGGATTGTAAGAGAAGGG GCTTACAGTCCTTTTTTTATGGTGTTCTATAAGCCTTTTTAAAA GGGGTACCACCCCACACCCAAAAACAGGGGGGGTTATAACTA CATATTGGATGTTTTGTAACGTACAAGAATCGGTATTAATTACC CTGTAAATAAGTTATGTGTATATAAGGTAACTTTATATATTCT CCTACAATAAAATAAAGGAGGTAATAAA |
| Cry1A promoter (*B. thuringiensis* HD-73) (SEQ ID NO: 179) | AACCCTTAATGCATTGGTTAAACATTGTAAAGTCTAAAGCATG GATAATGGGCGAGAAGTAAGTAGATTGTTAACACCCTGGGTCA AAAATTGATATTTAGTAAAATTAGTTGCACTTTGTGCATTTTTT CATAAGATGAGTCATATGTTTTAAATTGTAGTAATGAAAAAC AGTATATATCATAATGAATTGGTATCTTAATAAAAGAGATGG AGGTAACTTA |
| ExsY promoter (*B. thuringiensis* serovar konkukian str. 97-27) (SEQ ID NO: 180) | TAATTCCACCTTCCCTTATCCTCTTTCGCCTATTTAAAAAAAGG TCTTGAGATTGTGACCAAATCTCCTCAACTCCAATATCTTATTA ATGTAAATACAAACAAGAAGATAAGGA |
| CotY promoter (*B. thuringiensis* Al Hakam) (SEQ ID NO: 181) | AGGATGTCTTTTTTTATATTGTATTATGTACATCCCTACTATATA AATTCCCTGCTTTTATCGTAAGAATTAACGTAATATCAACCATA TCCCGTTCATATTGTAGTAGTGTATGTCAGAACTCACGAGAAG GAGTGAACATAA |

TABLE 19 -continued

Promoter Sequences for Expression of Fusion Proteins in Recombinant
*Bacillus cereus* family members

| Promoter (SEQ ID NO) | Promoter Sequence |
|---|---|
| YjcA promoter (*B. thuringiensis* serovar kurstaki str. HD73) (SEQ ID NO: 182) | TTAATGTCACTCCTTATCTTCTTGTTTGTATTTACATTAATAAG ATATTGGAGTTGAGGAGATTTGGTCACAATCTCAAGACCTTTTT TTTAAATAGGCGAAAGAGGATAAGGGAAGGTGGAATT |
| YjcB promoter (*B. thuringiensis* serovar kurstaki str. HD73) (SEQ ID NO: 183) | ATATATTTTCATAATACGAGAAAAAGCGGAGTTTAAAAGAATG AGGGAACGGAAATAAAGAGTTGTTCATATAGTAAATAGACAG AA |
| ExsFA/BxpB promoter (*B. thuringiensis* Al Hakam) (SEQ ID NO: 184) | AAACTAAATAATGAGCTAAGCATGGATTGGGTGGCAGAATTAT CTGCCACCCAATCCATGCTTAACGAGTATTATTATGTAAATTT CTTAAAATTGGGAACTTGTCTAGAACATAGAACCTGTCCTTTTC ATTAACTGAAAGTAGAAACAGATAAAGGAGTGAAAAAC |
| Rhamnose promoter (*B. thuringiensis* Al Hakam) (SEQ ID NO: 185) | ATTCACTACAACGGGGATGAGTTTGATGCGGATACATATGAG AAGTACCGGAAAGTGTTTGTAGAACATTACAAAGATATATTAT CTCCATCATAAAGGAGAGATGCAAAG |
| CotO promoter (*B. anthracis* Sterne) (SEQ ID NO: 186) | CGCGCACCCACTTCGTCGTACAACAACGCAAGAAGAAGTTGGGG ATACAGCAGTATTCTTATTCAGTGATTTAGCACGCGGCGTAAC AGGAGAAAACATTCACGTTGATTCAGGGTATCATATCTTAGGA TAAATATAATATTAATTTTAAAGGACAATCTCTACATGTTGAG ATTGTCCTTTTTATTTGTTCTTAGAAAGAACGATTTTTAACGAA AGTTCTTACCACGTTATGAATATAAGTATAATAGTACACGATTT ATTCAGCTACGTA |
| Sigma K promoter (*B. anthracis* Sterne) (SEQ ID NO: 187) | TATATCATATGTAAAATTAGTTCTTATTCCCACATATCATATAG AATCGCCATATTATACATGCAGAAAACTAAGTATGGTATTATT CTTAAATTGTTTAGCACCTTCTAATATTACAGATAGAATCCGTC ATTTTCAACAGTGAACATGGATTTCTTCTGAACACAACTCTTTT TCTTTCCTTATTTCCAAAAAGAAAAGCAGCCCATTTTAAAATAC GGCTGCTTGTAATGTACATTA |
| InhA1 promoter (*B. thuringiensis* Al Hakam) (SEQ ID NO: 188) | TATCACATAACTCTTTATTTTTAATATTTCGACATAAAGTGAAA CTTTAATCAGTGGGGGCTTTGTTCATCCCCCCACTGATTATTAA TTGAACCAAGGGATAAAAAGATAGAGGGTCTGACCAGAAAAC TGGAGGGCATGATTCTATAACAAAAAGCTTAATGTTTATAGAA TTATGTCTTTTTATATAGGGAGGGTAGTAAACAGAGATTTGGA CAAAAATGCACCGATTTATCTGAATTTTAAGTTTTATAAGGG GAGAAATG |
| BclA cluster glycosyl transferase operon 1 (*B. thuringiensis* serovar konkukian str. 97-27) (SEQ ID NO: 189) | ATTTTTTACTTAGCAGTAAAACTGATATCAGTTTTACTGCTTTTT CATTTTTAAATTCAATCATTAAATCTTCCTTTTCTACATAGTCA TAATGTTGTATGACATTCCGTAGGAGGCACTTATA |
| BclA cluster glycosyl transferase operon 2 (*B. thuringiensis* serovar kurstaki str. HD73) (SEQ ID NO: 190) | ACATAAATTCACCTCCATAAAGCGTTCATTATATAGTAGATGC AAAACCGAAAGAAAATGACACGGACATTTGAATTATTGAAAA GAAATCTTAAACTACTTGAACAATTTAAAAAAATGGAAAGTTT AGTATATGTATAACATATGATTGATTTGGAAGAGGGTGATTA |
| Glycosyl transferase promoter (*B. thuringiensis* Al Hakam) (SEQ ID NO: 191) | TTCTATTTTCCAACATAACATGCTACGATTAAATGGTTTTTGC AAATGCCTTCTTGGGAAGAAGGATTAGAGCGTTTTTTTATAGA AACCAAAAGTCATTAACAATTTTAAGTTAATGACTTTTTTGTTT GCCTTTAAGAGGTTTTATGTTACTATAATTATAGTATCAGGTAC TAATAACAAGTATAAGTATTTCTGGGAGGATATATCA |

The sigma-K sporulation-specific polymerase promoter sequences in the promoter sequences shown in Table 19 result in high expression levels of the fusion protein during late sporulation. The consensus sequence for the sigma-K sporulation-specific polymerase promoter sequence is CAT-ANNNTN (SEQ ID NO: 361); however, this sequence can comprise up to two mutations and still be functional. The sigma-K sporulation-specific polymerase promoter sequence is generally found upstream of the ribosome binding site (RBS).

Promoters having a high degree of sequence identity to any of the sequences shown above in Table 19 can also be used to express the fusion proteins.

For example, the fusion protein can be expressed under the control of a promoter comprising a nucleic acid sequence having at least 80% identity with a nucleic acid sequence of any one of SEQ ID NOs: 37-42 and 123-191.

The fusion protein can be expressed under the control of a promoter comprising a nucleic acid sequence having at least 85% identity with a nucleic acid sequence of any one of SEQ ID NOs: 37-42 and 123-191.

The fusion protein can be expressed under the control of a promoter comprising a nucleic acid sequence having at least 90% identity with a nucleic acid sequence of any one of SEQ ID NOs: 37-42 and 123-191.

The fusion protein can be expressed under the control of a promoter comprising a nucleic acid sequence having at least 95% identity with a nucleic acid sequence of any one of SEQ ID NOs: 37-42 and 123-191.

The fusion protein can be expressed under the control of a promoter comprising a nucleic acid sequence having at least 98% identity with a nucleic acid sequence of any one of SEQ ID NOs: 37-42 and 123-191.

The fusion protein can be expressed under the control of a promoter comprising a nucleic acid sequence having at least 99% identity with a nucleic acid sequence of any one of SEQ ID NOs: 37-42 and 123-191.

The fusion protein can be expressed under the control of a promoter comprising a nucleic acid sequence having 100% identity with a nucleic acid sequence of any one of SEQ ID NOs: 37-42 and 123-191.

For example, fusion protein can be expressed under the control of a BclA promoter (e.g., SEQ ID NO: 149, 150, 175, 189, or 190), a CotY promoter (e.g., SEQ ID NO: 41, 42, or 181), an ExsY promoter (e.g., SEQ ID NO: 37, 38, or 180), or a rhamnose promoter (e.g., SEQ ID NO: 185), or a promoter having a high degree of sequence identity to any of these promoters.

Thus, for example, the fusion protein can be expressed under the control of a promoter comprising a nucleic acid sequence having at least 80% identity with a nucleic acid sequence of any one of SEQ ID NOs: 37, 38, 41, 42, 149, 150, 175, 180, 181, 185, 189, or 190.

The fusion protein can be expressed under the control of a promoter comprising a nucleic acid sequence having at least 85% identity with a nucleic acid sequence of any one of SEQ ID NOs: 37, 38, 41, 42, 149, 150, 175, 180, 181, 185, 189, or 190.

The fusion protein can be expressed under the control of a promoter comprising a nucleic acid sequence having at least 90% identity with a nucleic acid sequence of any one of SEQ ID NOs: 37, 38, 41, 42, 149, 150, 175, 180, 181, 185, 189, or 190.

The fusion protein can be expressed under the control of a promoter comprising a nucleic acid sequence having at least 95% identity with a nucleic acid sequence of any one of SEQ ID NOs: 37, 38, 41, 42, 149, 150, 175, 180, 181, 185, 189, or 190.

The fusion protein can be expressed under the control of a promoter comprising a nucleic acid sequence having at least 98% identity with a nucleic acid sequence of any one of SEQ ID NOs: 37, 38, 41, 42, 149, 150, 175, 180, 181, 185, 189, or 190.

The fusion protein can be expressed under the control of a promoter comprising a nucleic acid sequence having at least 99% identity with a nucleic acid sequence of any one of SEQ ID NOs: 37, 38, 41, 42, 149, 150, 175, 180, 181, 185, 189, or 190.

The fusion protein can be expressed under the control of a promoter comprising a nucleic acid sequence having 100% identity with a nucleic acid sequence of any one of SEQ ID NOs: 37, 38, 41, 42, 149, 150, 175, 180, 181, 185, 189, or 190.

The fusion protein can be expressed under the control of a promoter comprising a sigma-K sporulation specific polymerase promoter sequence, wherein the sigma-K sporulation-specific polymerase promoter sequence or sequences have 100% identity with the corresponding nucleotides of any of SEQ ID NOs: 37-42 and 123-191.

The fusion proteins can be expressed under the control of a promoter that is native to the targeting sequence, exosporium protein, or exosporium protein fragment of the fusion protein. Thus, for example, where the targeting sequence is derived from BclA, the fusion protein can be expressed under the control of a native BclA promoter (e.g., SEQ ID NO: 149, 150, 175, 189 or 190).

Table 19 also provides illustrative minimal promoter sequences. The fusion proteins can be expressed under any of these minimal promoter sequences.

Furthermore, the fusion protein can be expressed under a portion of any of the promoters listed above in Table 19, so long as the portion of the promoter includes a sigma-K sporulation-specific polymerase promoter sequence. For example, the fusion protein can be expressed under a promoter region that comprises the first 25, 50, 100, 150, 200, 250, or 300 nucleotides upstream of the start codon, so long as that region comprises a sigma-K sporulation-specific polymerase promoter sequence.

IV. Mutations and Other Genetic Alterations to Recombinant *Bacillus cereus* Family Members that Allow for Collection of Free Exosporium and Exosporium Fragments Derived from Such Recombinant *Bacillus cereus* Family Members As is described further hereinbelow, the recombinant *Bacillus cereus* family members that express fusion proteins comprising a protein or peptide of interest (e.g., an enzyme having ACC deaminase activity, a phospholipase, a lipase, a xylanase, a xylosidase, a lactonase, a chitosanase, a protease, a glucanase, a phytase, an acid phosphatase, a pectinase, a mannanase, and/or an expansin protein) and a targeting sequence, an exosporium protein, or an exosporium protein fragment that targets the fusion protein to the exosporium of the recombinant *Bacillus cereus* family member can be used for various purposes, including delivering the proteins or peptides of interest plants, seeds, a plant growth medium, or an area surrounding a seed or a plant (e.g., via soil drench, foliar application, or as a seed treatment). However, in some cases, the presence of the living microorganisms may not be desirable, and instead, it would be desirable to separate the living spore from the fusion proteins in the exosporium on the outside surface of the spore. For example, in some applications it will be desirable to increase enzyme activity without concern for spore integrity. In such situations, use of exosporium fragments that have been separated from the spores may be preferred over the use of living microorganisms having the enzyme on their exosporium.

In addition, for some uses, it may be desirable to reduce the density of the product. In such instances, it would be desirable to separate the dense spore from the exosporium (containing the fusion proteins). Furthermore, under some circumstances the presence of live spores would lead to potential for bacterial growth in a product, which would be undesirable for some applications.

Mutations or other genetic alterations (e.g., overexpression of a protein) can be introduced into the recombinant *Bacillus cereus* family members that allow free exosporium to be separated from spores of the recombinant *Bacillus cereus* family member. This separation process yields exosporium fragments that contain the fusion proteins but that are substantially free of the spores themselves. By "substantially free of spores" it is meant that once the free exosporium is separated from the spores, a preparation is obtained that contains less than 5% by volume of spores, preferably less than 3% by volume of spores, even more preferably less than 1% by volume of spores, and most preferably contains no spores or if spores are present, they are undetectable. These exosporium fragments can be used in place of the recombinant *Bacillus cereus* family members themselves in any of the formulations, plant seeds, and methods described herein.

Exosporium fragments derived from spores of a recombinant *Bacillus cereus* family member can be used in any of the formulations, plant seeds, and methods described herein. The recombinant *Bacillus cereus* family member expresses any of the fusion proteins described herein. The recombinant *Bacillus cereus* family member also comprises a mutation or expresses a protein, wherein the expression of the protein is increased as compared to the expression of the protein in a wild-type *Bacillus cereus* family member under the same conditions. The mutation or the increased expression of the protein results in *Bacillus cereus* family member spores having an exosporium that is easier to remove from the spore as compared to the exosporium of a wild-type spore.

The recombinant *Bacillus cereus* family member: (i) can comprise a mutation in a CotE gene; (ii) can express an ExsY protein, wherein the expression of the ExsY protein is increased as compared to the expression of the ExsY protein in a wild-type *Bacillus cereus* family member under the same conditions, and wherein the ExsY protein comprises a carboxy-terminal tag comprising a globular protein; (iii) can express a BclB protein, wherein the expression of the BclB protein is increased as compared to the expression of the BclB protein in a wild-type *Bacillus cereus* family member under the same conditions; (iv) can express a YjcB protein, wherein the expression of the YjcB protein is increased as compared to the expression of the YjcB protein in a wild-type *Bacillus cereus* family member under the same conditions; (v) can comprise a mutation in an ExsY gene; (vi) can comprise a mutation in a CotY gene; (vii) can comprise a mutation in an ExsA gene; or (viii) can comprise a mutation in a CotO gene.

The recombinant *Bacillus cereus* family member can comprise a mutation in the CotE gene, such as a knock-out of the CotE gene or a dominant negative form of the CotE gene. The mutation in the CotE gene can partially or completely inhibit the ability of CotE to attach the exosporium to the spore.

The recombinant *Bacillus cereus* family member can express an ExsY protein. The ExsY protein comprises a carboxy-terminal tag comprising a globular protein (e.g., a green fluorescent protein (GFP) or a variant thereof), and the expression of the ExsY protein is increased as compared to the expression of the ExsY protein in a wild-type *Bacillus cereus* family member under the same conditions. The globular protein can have a molecular weight of between 25 kDa and 100 kDa. Expression of the ExsY protein comprising the carboxy-terminal tag comprising a globular protein can inhibit binding of the ExsY protein to its targets in the exosporium.

The recombinant *Bacillus cereus* family member can express a BclB protein. Expression of the BclB protein can result in the formation of a fragile exosporium. The expression of the BclB protein can be increased as compared to the expression of the BclB protein in a wild-type *Bacillus cereus* family member under the same conditions.

The recombinant *Bacillus cereus* family member can express a YjcB protein. Expression of the YjcB protein can cause the exosporium to form in pieces rather than in a complete structure. The expression of the YjcB protein can be increased as compared to the expression of the YjcB protein in a wild-type *Bacillus cereus* family member under the same conditions.

The recombinant *Bacillus cereus* family member can comprise a mutation an ExsY gene, such as a knock-out of the ExsY gene. The mutation in the ExsY gene can partially or completely inhibit the ability of ExsY to complete the formation of the exosporium or attach the exosporium to the spore.

The recombinant *Bacillus cereus* family member can comprise a mutation a CotY gene, such as a knock-out of the CotY gene. The mutation in the CotY gene can result in the formation of a fragile exosporium.

The recombinant *Bacillus cereus* family member can comprise a mutation an ExsA gene, such as a knock-out of the ExsA gene. The mutation in the ExsA gene can result in the formation of a fragile exosporium.

The recombinant *Bacillus cereus* family member can comprise a mutation a CotO gene, such as a knock-out of the CotO gene or a dominant negative form of the CotO gene. The mutation in the CotO gene can cause the exosporium to form in strips.

For ease of reference, descriptions of illustrative sequences for CotE, ExsY, BclB, YjcB, CotY, ExsA, and CotO are provided in Table 20 below.

TABLE 20

Sequences of Proteins that Can be Mutated or Otherwise Genetically Altered to Allow for Collection of Free Exosporium

| Protein | SEQ ID NO. |
|---|---|
| CotE, *Bacillus cereus* group | 192 |
| ExsY, *Bacillus thuringiensis* | 193 |
| BclB, variant 1, *Bacillus anthracis* Sterne | 194 |
| BclB, variant 2, *Bacillus anthracis* Sterne | 195 |
| YjcB, Variant 1, *Bacillus cereus* | 196 |
| YjcB, Variant 2, *Bacillus cereus* | 197 |
| CotY, *Bacillus cereus* | 198 |
| CotO, *Bacillus anthracis* | 199 |

Exosporium fragments can be prepared from any of these recombinant *Bacillus cereus* family members and used for various purposes as described further hereinbelow. Where the recombinant *Bacillus cereus* family member expresses a fusion protein, the exosporium fragments will comprise the fusion proteins. Upon purification of the exosporium fragments that contain the fusion proteins from the spores, a cell-free protein preparation is obtained in which the fusion proteins are stabilized and supported through covalent bonds to the exosporium fragments.

To remove the exosporium from spores of the recombinant *Bacillus cereus* family members that have mutations or other genetic alterations that allow for collection of free exosporium, a suspension of the spores can be subjected to centrifugation or filtration to produce fragments of exosporium that are separated from the spores. Where the recombinant *Bacillus cereus* family member expresses a fusion protein, the exosporium fragments will comprise the fusion protein.

A suspension comprising the spores can be subjected to centrifugation, followed by collection of the supernatant. The supernatant comprises the fragments of the exosporium and is substantially free of spores.

Alternatively, a suspension comprising the spores can be subjected to filtration, followed by collection of the filtrate.

The filtrate comprises the fragments of the exosporium and is substantially free of spores.

The suspension of spores can be agitated or mechanically disrupted prior to centrifugation or filtration.

The exosporium fragments can also be separated from the spores by gradient centrifugation, affinity purification, or by allowing the spores to settle out of the suspension.

Due to the strong covalent bonds between the fusion proteins and the exosporium fragments, the fusion proteins become resistant to heat. The heat resistance of the fusion proteins bound to the exosporium fragments allows them to be used for applications that require heat-resistant proteins or enzymes.

Exosporium fragments derived from a recombinant *Bacillus cereus* family member are provided.

The exosporium fragments can be derived from any of the recombinant *Bacillus cereus* family members that comprise any of the mutations or other genetic alterations described herein that allow for collection of free exosporium.

The exosporium fragments can comprise any of the fusion proteins described above in Section I.

V. Formulations

A formulation is provided. The formulation comprises any of the recombinant *Bacillus cereus* family members described herein. The formulation further comprises an agriculturally acceptable carrier.

Another formulation is provided. The formulation comprises exosporium fragments derived from any of the recombinant *Bacillus cereus* family members described herein. The formulation further comprises an agriculturally acceptable carrier.

In any of the formulations, the fusion protein can comprises a *Bacillus cereus* phosphatidylcholine-specific phospholipase C and the formulation can further comprise a mannanase or a xyloglucanase.

In any of the formulations, the fusion protein can comprise a mannanase and the formulation can further comprise a *Bacillus cereus* phosphatidylcholine-specific phospholipase C.

In any of the formulations, the fusion protein can comprise a xyloglucanase and the formulation can further comprise a *Bacillus cereus* phosphatidylcholine-specific phospholipase C.

In any of the formulations wherein the formulation comprises a *Bacillus cereus* phosphatidylcholine-specific phospholipase C and a mannanase or a xyloglucanase, the *Bacillus cereus* phosphatidylcholine-specific phospholipase C can comprise SEQ ID NO: 257.

In any of the formulations wherein the formulation comprises a *Bacillus cereus* phosphatidylcholine-specific phospholipase C and a mannanase or a xyloglucanase, the mannanase can comprise SEQ ID NO: 307.

In any of the formulations wherein the formulation comprises a *Bacillus cereus* phosphatidylcholine-specific phospholipase C and a mannanase or a xyloglucanase, the xyloglucanase can comprise SEQ ID NO: 299.

Amino acid sequences having a high degree of sequence identity to SEQ ID NO: 257, 307, and/or 299 can also be used. Thus, for example, the *Bacillus cereus* phosphatidylcholine-specific phospholipase C can comprise an amino acid sequence having at least 70%, at least 75%, at least 80%, at least 85%, at least 90%, at least 95%, at least 98%, at least 99%, or 100% identity to SEQ ID NO: 257; the mannanase can comprise an amino acid sequence having at least 70%, at least 75%, at least 80%, at least 85%, at least 90%, at least 95%, at least 98%, at least 99%, or 100% identity to SEQ ID NO: 307; and/or the xyloglucanase can comprise an amino acid sequence having at least 70%, at least 75%, at least 80%, at least 85%, at least 90%, at least 95%, at least 98%, at least 99%, or 100% identity to SEQ ID NP: 299.

In any of the formulations wherein the fusion protein comprises a *Bacillus cereus* phosphatidylcholine-specific phospholipase C and the formulation further comprises a mannanase or a xyloglucanase, the mannanase or the xyloglucanase can also be part of a fusion protein. Where the mannanase or xyloglucanase is part of a fusion protein, the fusion protein can be co-expressed in the same recombinant *Bacillus cereus* family member as the phosphatidylcholine-specific phospholipase C. Alternatively or in addition, the formulation can comprise a second recombinant *Bacillus cereus* family member that expresses a fusion protein comprising the mannanase or the xyloglucanase.

Alternatively or in addition, in any of the formulations where the fusion protein comprises a *Bacillus cereus* phosphatidylcholine-specific phospholipase C and the formulation further comprises a mannanase or a xyloglucanase, the mannanase or xyloglucanase can be in the form of a free enzyme.

In any of the formulations wherein the fusion protein comprises a mannanase and the formulation further comprises a *Bacillus cereus* phosphatidylcholine-specific phospholipase C, the *Bacillus cereus* phosphatidylcholine-specific phospholipase C can also be part of a fusion protein. Where the *Bacillus cereus* phosphatidylcholine-specific phospholipase C is part of a fusion protein, the fusion protein can be co-expressed in the same recombinant *Bacillus cereus* family member as the mannanase. Alternatively or in addition, the formulation can comprise a second recombinant *Bacillus cereus* family member that expresses a fusion protein comprising the *Bacillus cereus* phosphatidylcholine-specific phospholipase C.

Alternatively or in addition, in any of the formulations wherein the fusion protein comprises a mannanase and the formulation further comprises a *Bacillus cereus* phosphatidylcholine-specific phospholipase C, the *Bacillus cereus* phosphatidylcholine-specific phospholipase C can be in the form of a free enzyme.

In any of the formulations wherein the fusion protein comprises a xyloglucanase and the formulation further comprises a *Bacillus cereus* phosphatidylcholine-specific phospholipase C, the *Bacillus cereus* phosphatidylcholine-specific phospholipase C can also be part of a fusion protein. Where the *Bacillus cereus* phosphatidylcholine-specific phospholipase C is part of a fusion protein, the fusion protein can be co-expressed in the same recombinant *Bacillus cereus* family member as the xyloglucanase. Alternatively or in addition, the formulation can comprise a second recombinant *Bacillus cereus* family member that expresses a fusion protein comprising the *Bacillus cereus* phosphatidylcholine-specific phospholipase C.

Alternatively or in addition, in any of the formulations wherein the fusion protein comprises a xyloglucanase and the formulation further comprises a *Bacillus cereus* phosphatidylcholine-specific phospholipase C, the *Bacillus cereus* phosphatidylcholine-specific phospholipase C can be in the form of a free enzyme.

In any of the formulations wherein the formulation comprises a *Bacillus cereus* phosphatidylcholine-specific phospholipase C and a mannanase, the phospholipase C and the mannanase are preferably present in synergistically effective amounts.

In any of the formulations wherein the formulation comprises a *Bacillus cereus* phosphatidylcholine-specific phospholipase C and a xyloglucanase, the phospholipase C and the xyloglucanase are preferably present in synergistically effective amounts.

In any of the formulations, the fusion protein can comprise a xyloglucanase and the formulation can further comprise a mannanase.

In any of the formulations, the fusion protein can comprise a mannanase and the formulation can further comprise a xyloglucanase.

In any of the formulations wherein the formulation comprises a xyloglucanase and a mannanase, the xyloglucanase can comprise SEQ ID NO: 299.

In any of the formulations wherein the formulation comprises a xyloglucanase and a mannanase, the mannanase can comprise SEQ ID NO: 307.

Amino acid sequences having a high degree of sequence identity to SEQ ID NO: 299 and/or 307 can also be used. Thus, the mannanase can comprise an amino acid sequence having at least 70%, at least 75%, at least 80%, at least 85%, at least 90%, at least 95%, at least 98%, at least 99%, or 100% identity to SEQ ID NO: 307; and/or the xyloglucanase can comprise an amino acid sequence having at least 70%, at least 75%, at least 80%, at least 85%, at least 90%, at least 95%, at least 98%, at least 99%, or 100% identity to SEQ ID NP: 299.

In any of the formulations wherein the fusion protein comprises a xyloglucanase and the formulation further comprises a mannanase, the mannanase can also be part of a fusion protein. Where the mannanase is part of a fusion protein, the fusion protein can be co-expressed in the same recombinant *Bacillus cereus* family member as the xyloglucanase. Alternatively or in addition, the formulation can comprise a second recombinant *Bacillus cereus* family member that expresses a fusion protein comprising the mannanase.

Alternatively or in addition, in any of the formulations wherein the fusion protein comprises a xyloglucanase and the formulation further comprises a mannanase, the mannanase can be in the form of a free enzyme.

In any of the formulations wherein the fusion protein comprises a mannanase and the formulation further comprises a xyloglucanase, the xyloglucanase can also be part of a fusion protein. Where the xyloglucanase is part of a fusion protein, the fusion protein can be co-expressed in the same recombinant *Bacillus cereus* family member as the mannanase. Alternatively or in addition, the formulation can comprise a second recombinant *Bacillus cereus* family member that expresses a fusion protein comprising the xyloglucanase.

Alternatively or in addition, in any of the formulations wherein the fusion protein comprises a mannanase and the formulation further comprises a xyloglucanase, the xyloglucanase can be in the form of a free enzyme.

In any of the formulations comprising a xyloglucanase and a mannanase, the xyloglucanase and the mannanase are preferably present in synergistically effective amounts.

In any of the formulations, the fusion protein can comprise an acid phosphatase comprising SEQ ID NO: 311, and the formulation can further comprise an acid phosphatase comprising SEQ ID NO: 312.

In any of the formulations wherein the fusion protein comprises an acid phosphatase comprising SEQ ID NO: 311 and the formulation further comprises an acid phosphatase comprising SEQ ID NO: 312, the acid phosphatase comprising SEQ ID NO: 312 can also be part of a fusion protein. Wherein the acid phosphatase comprising SEQ ID NO: 312 is part of a fusion protein, the fusion protein can be co-expressed in the same recombinant *Bacillus cereus* family member as the acid phosphatase comprising SEQ ID NO: 311. Alternatively or in addition, the formulation can comprise a second recombinant *Bacillus cereus* family member that expresses a fusion protein comprising the acid phosphatase comprising SEQ ID NO: 312.

Alternatively or in addition, in any of the formulations wherein the fusion protein comprises an acid phosphatase comprising SEQ ID NO: 311 and the formulation further comprises an acid phosphatase comprising SEQ ID NO: 312, the acid phosphatase comprising SEQ ID NO: 312 can be in the form of a free enzyme.

In any of the formulations, the fusion protein can comprise an acid phosphatase comprising SEQ ID NO: 312, and the formulation can further comprise an acid phosphatase comprising SEQ ID NO: 311.

In any of the formulations wherein the fusion protein comprises an acid phosphatase comprising SEQ ID NO: 312 and the formulation further comprises an acid phosphatase comprising SEQ ID NO: 311, the acid phosphatase comprising SEQ ID NO: 311 can also be part of a fusion protein. Wherein the acid phosphatase comprising SEQ ID NO: 311 is part of a fusion protein, the fusion protein can be co-expressed in the same recombinant *Bacillus cereus* family member as the acid phosphatase comprising SEQ ID NO: 312. Alternatively or in addition, the formulation can comprise a second recombinant *Bacillus cereus* family member that expresses a fusion protein comprising the acid phosphatase comprising SEQ ID NO: 311.

Alternatively or in addition, in any of the formulations wherein the fusion protein comprises an acid phosphatase comprising SEQ ID NO: 312 and the formulation further comprises an acid phosphatase comprising SEQ ID NO: 311, the acid phosphatase comprising SEQ ID NO: 311 can be in the form of a free enzyme.

Another formulation is provided. The formulation comprises a recombinant *Bacillus cereus* family member that expresses a fusion protein. Alternatively or in addition, the formulation comprises exosporium fragments derived from a *Bacillus cereus* family member that expresses a fusion protein. The fusion protein comprises a targeting sequence, exosporium protein, or exosporium protein fragment that targets the fusion protein to the exosporium of a recombinant *Bacillus cereus* family member. The fusion protein further comprises an acid phosphatase. The formulation further comprises a second enzyme.

The second enzyme suitably comprises a lipase, a phospholipase, a glucanase, a xylanase, a pectinase, a mannanase, a lichenase, or a combination of any thereof. The lipase, phospholipase, glucanase, xylanase, pectinase, mannanase, or lichenase can comprise any of the lipases, phospholipases, glucanases, xylanases, pectinases, mannanases, or lichenases described herein.

The acid phosphatase suitably comprises a *Triticum aestivum* acid phosphatase.

For example, the acid phosphatase can comprise an amino acid sequence having at least 70% identity to SEQ ID NO: 311 or 312.

The acid phosphatase can comprise an amino acid sequence having at least 75% identity to SEQ ID NO: 311 or 312.

The acid phosphatase can comprise an amino acid sequence having at least 80% identity to SEQ ID NO: 311 or 312.

The acid phosphatase can comprise an amino acid sequence having at least 85% identity to SEQ ID NO: 311 or 312.

The acid phosphatase can comprise an amino acid sequence having at least 90% identity to SEQ ID NO: 311 or 312.

The acid phosphatase can comprise an amino acid sequence having at least 95% identity to SEQ ID NO: 311 or 312.

The acid phosphatase can comprise an amino acid sequence having at least 98% identity to SEQ ID NO: 311 or 312.

The acid phosphatase can comprise an amino acid sequence having at least 99% identity to SEQ ID NO: 311 or 312.

The acid phosphatase can comprise an amino acid sequence having 100% identity to SEQ ID NO: 311 or 312.

Another formulation is provided. The formulation comprises a recombinant *Bacillus cereus* family member that expresses a fusion protein. Alternatively or in addition, the formulation comprises exosporium fragments derived from a *Bacillus cereus* family member that expresses a fusion protein. The fusion protein comprises a targeting sequence, exosporium protein, or exosporium protein fragment that targets the fusion protein to the exosporium of a recombinant *Bacillus cereus* family member. The fusion protein further comprises a phospholipase C. The formulation further comprises a second enzyme.

In any of the formulations wherein the fusion protein comprises a phospholipase C, the phospholipase C can comprise a *Bacillus thuringiensis* phospholipase C.

In any of the formulations wherein the fusion protein comprises a phospholipase C, the phospholipase C can comprise an amino acid sequence having at least 70% identity to SEQ ID NO: 250 or SEQ ID NO: 251.

The phospholipase C can comprise an amino acid sequence having at least 75% identity to SEQ ID NO: 250 or SEQ ID NO: 251.

The phospholipase C can comprise an amino acid sequence having at least 80% identity to SEQ ID NO: 250 or SEQ ID NO: 251.

The phospholipase C can comprise an amino acid sequence having at least 85% identity to SEQ ID NO: 250 or SEQ ID NO: 251.

The phospholipase C can comprise an amino acid sequence having at least 90% identity to SEQ ID NO: 250 or SEQ ID NO: 251.

The phospholipase C can comprise an amino acid sequence having at least 95% identity to SEQ ID NO: 250 or SEQ ID NO: 251.

The phospholipase C can comprise an amino acid sequence having at least 98% identity to SEQ ID NO: 250 or SEQ ID NO: 251.

The phospholipase C can comprise an amino acid sequence having at least 99% identity to SEQ ID NO: 250 or SEQ ID NO: 251.

The phospholipase C can comprise an amino acid sequence having 100% identity to SEQ ID NO: 250 or SEQ ID NO: 251.

In any of the formulations wherein the fusion protein comprises a phospholipase C, the phospholipase C can consist essentially of SEQ ID NO: 250 or SEQ ID NO: 251.

In any of the formulations wherein the fusion protein comprises a phospholipase C, the phospholipase C can consist of SEQ ID NO: 250 or SEQ ID NO: 251.

The second enzyme suitably comprises a xylogluconase or a mannanase.

When the second enzyme comprises a xylogluconase, the xylogluconase can comprise a *Paenibacillus pabuli* xylogluconase or a *Bacillus licheniformis* xylogluconase.

When the second enzyme comprises a xylogluconase, the xylogluconase can comprise an amino acid sequence having at least 70% identity to SEQ ID NO: 299 or 300.

The xylogluconase can comprise an amino acid sequence having at least 70% identity to SEQ ID NO: 299 or 300.

The xylogluconase can comprise an amino acid sequence having at least 75% identity to SEQ ID NO: 299 or 300.

The xylogluconase can comprise an amino acid sequence having at least 80% identity to SEQ ID NO: 299 or 300.

The xylogluconase can comprise an amino acid sequence having at least 85% identity to SEQ ID NO: 299 or 300.

The xylogluconase can comprise an amino acid sequence having at least 90% identity to SEQ ID NO: 299 or 300.

The xylogluconase can comprise an amino acid sequence having at least 95% identity to SEQ ID NO: 299 or 300.

The xylogluconase can comprise an amino acid sequence having at least 98% identity to SEQ ID NO: 299 or 300.

The xylogluconase can comprise an amino acid sequence having at least 99% identity to SEQ ID NO: 299 or 300.

The xylogluconase can comprise an amino acid sequence having 100% identity to SEQ ID NO: 299 or 300.

The phospholipase C can comprise SEQ ID NO: 250 and the xylogluconase can comprise SEQ ID NO: 299. Alternatively, the phospholipase C can comprise SEQ ID NO: 250 and the xylogluconase can comprise SEQ ID NO: 300.

In any of the formulations described herein comprising a phospholipase C and a second enzyme comprising a xylogluconase, the phospholipase C and the xylogluconase can be present in synergistically effective amounts.

When the second enzyme comprises a mannanase, the mannanase can comprise a *Bacillus circulans* mannanase or a *Bacillus subtilis* mannanase.

Alternatively or in addition, when the second enzyme comprises a mannanase, the mannanase can comprise an amino acid sequence having at least 70% identity to SEQ ID NO: 307 or 308.

The mannanase can comprise an amino acid sequence having at least 75% identity to SEQ ID NO: 307 or 308.

The mannanase can comprise an amino acid sequence having at least 80% identity to SEQ ID NO: 307 or 308.

The mannanase can comprise an amino acid sequence having at least 85% identity to SEQ ID NO: 307 or 308.

The mannanase can comprise an amino acid sequence having at least 90% identity to SEQ ID NO: 307 or 308.

The mannanase can comprise an amino acid sequence having at least 95% identity to SEQ ID NO: 307 or 308.

The mannanase can comprise an amino acid sequence having at least 98% identity to SEQ ID NO: 307 or 308.

The mannanase can comprise an amino acid sequence having at least 99% identity to SEQ ID NO: 307 or 308.

The mannanase can comprise an amino acid sequence having 100% identity to SEQ ID NO: 307 or 308.

In any of the formulations described herein comprising a phospholipase C and a second enzyme comprising a mannanase, the phospholipase C can comprise SEQ ID NO: 250 and the mannanase can comprise SEQ ID NO: 308. Alternatively, the phospholipase C can comprise SEQ ID NO: 250 and the mannanase can comprise SEQ ID NO: 307.

In any of the formulations described herein comprising a phospholipase C and a second enzyme comprising a mannanase, the phospholipase C and the mannanase can be present in synergistically effective amounts.

Any of the formulations described herein can further comprise an agrochemical. Suitable agrochemicals are described below in Section IX.

Any of the formulations described herein can further comprise a fertilizer, a biostimulant, or a combination thereof. Suitable fertilizers and biostimulants are described below in Section IX.

VI. Treated Seeds

A treated plant seed is provided. The plant seed can be treated with any of the recombinant *Bacillus cereus* family members described herein. The recombinant *Bacillus cereus* family member can express any of the fusion proteins described herein.

Another treated plant seed is provided. The plant seed can be treated with any of the exosporium fragments described herein. The exosporium fragments can be derived from any of the *Bacillus cereus* family members described herein. The exosporium fragments can comprise any of the fusion proteins described herein.

Yet another treated plant seed is provided. The plant seed can be treated with any of the formulations described herein.

In any of the treated plant seeds, the plant seed can be coated with the recombinant *Bacillus cereus* family member, the exosporium fragments, or the formulation.

The recombinant *Bacillus cereus* family members, exosporium fragments, or formulations can used as seed treatments, e.g., seed coatings or dressings. Seed coating or dressing formulations may be in the form of a liquid carrier formulation, a slurry formulation, or a powder formulation.

Seed coating or dressing formulations can be applied with conventional additives that are provided to make the seed treatment have sticky qualities to stick to and coat the seeds. Suitable additives comprise: talcs, graphites, gums, stabilizing polymers, coating polymers, finishing polymers, slip agents for seed flow and plantability, cosmetic agents, and cellulosic materials such as carboxymethyl cellulose and the like.

The seed treatments formulations can further comprise colorant agents and/or other additives.

The recombinant *Bacillus cereus* family members, exosporium fragments, or formulations of the invention can be applied as seed treatments by themselves or can be applied in with other agrochemicals such as fungicides, insecticides, inoculants, plant growth regulators, plant growth promoting microbes, fertilizers, fertilizer enhancers, seed nutrients, biocontrol agents, herbicidal antidotes and seedling disease treatments and with other conventional seed treatments.

The seed treatment formulations(s) may be applied to seeds in a suitable carrier such as water or a powder. The seeds can then be allowed to dry and planted in conventional fashion. The recombinant *Bacillus cereus* family members or exosporium fragments can be applied directly to the seed as a solution or in combination with other commercially available additives. For example, the recombinant *Bacillus cereus* family members or exosporium fragments can be applied in combination with seedling-acceptable carrier(s) (e.g., a liquid carrier or a solid carrier).

Solutions containing the recombinant *Bacillus cereus* family members or exosporium fragments can be sprayed or otherwise applied to the seed (e.g., in a seed slurry or a seed soak).

Solid or dry materials containing recombinant *Bacillus cereus* family members or exosporium fragments are also useful to promote effective seedling germination, growth, and protection during early seedling establishment.

The recombinant *Bacillus cereus* family members or exosporium fragments can be used with a solubilizing carrier such as water, a buffer (e.g., citrate or phosphate buffer), other treating agents (e.g., alcohol or another solvent), and/or any soluble agent.

In addition, small amounts of drying agent enhancers, such as lower alcohols, etc. can be used in seed coating formulations.

Surfactants, emulsifiers and preservatives can also be added at relatively low (e.g., about 0.5% w/v or less) levels in order to enhance the stability of the seed coating product.

Seeds can be treated using a variety of methods including, but not limited to, pouring, pumping, drizzling, or spraying an aqueous solution containing the recombinant *Bacillus cereus* family members or exosporium fragments on or over a seed; or spraying or applying the recombinant *Bacillus cereus* family members or exosporium fragments onto a layer of seeds either with or without the use of a conveyor system.

Mixing devices useful for seed treatment include but are not limited to tumblers, mixing basins, mixing drums, and fluid application devices that include basins or drums used to contain the seed while coating.

After seed treatment, the seed may be air-dried or a stream of dry air may be optionally used to aid in the drying of the seed coatings.

Seed treatments containing the recombinant *Bacillus cereus* family members or exosporium fragments can be applied using any commercially available seed treatment machinery or can also be applied using any acceptable non-commercial method(s) such as the use of syringes or any other seed treatment device.

VII. Methods for Stimulating Plant Growth and/or Promoting Plant Health

A method for stimulating plant growth and/or promoting plant health is provided. The method comprises applying a recombinant *Bacillus cereus* family member to a plant growth medium, a plant, a plant seed, or an area surrounding a plant or a plant seed. The recombinant *Bacillus cereus* family member can comprise any of the recombinant *Bacillus cereus* family members described herein. The recombinant *Bacillus cereus* family member can express any of the fusion proteins described herein.

Another method for stimulating plant growth and/or promoting plant health is provided. The method comprises applying exosporium fragments to a plant growth medium, a plant, a plant seed, or an area surrounding a plant or a plant seed. The exosporium fragments can comprise exosporium fragments derived from any of the recombinant *Bacillus cereus* family members described herein. The exosporium fragments can comprise any of the fusion proteins described herein.

Yet another method for stimulating plant growth and/or promoting plant health is provided. The method comprises applying a formulation to a plant growth medium, a plant, a plant seed, or an area surrounding a plant or a plant seed. The formulation can comprise any of the formulations described herein.

In any of the methods for stimulating plant growth and/or promoting plant health, the fusion protein can comprise a *Bacillus cereus* phosphatidylcholine-specific phospholipase C and the method can further comprise applying a mannanase or a xyloglucanase to the plant growth medium, plant, plant seed, or area surrounding the plant or the plant seed.

In any of the methods for stimulating plant growth and/or promoting plant health, the fusion protein can comprise a mannanase and the method can further comprise applying a *Bacillus cereus* phosphatidylcholine-specific phospholipase C to the plant growth medium, plant, plant seed, or area surrounding the plant or the plant seed.

In any of the methods for stimulating plant growth and/or promoting plant health, the fusion protein can comprise a xyloglucanase and the method can further comprise applying a *Bacillus cereus* phosphatidylcholine-specific phospholipase C to the plant growth medium, plant, plant seed, or area surrounding the plant or the plant seed.

In any of the methods that comprise applying a *Bacillus cereus* phosphatidylcholine-specific phospholipase C and a mannanase or a xyloglucanase, the *Bacillus cereus* phosphatidylcholine-specific phospholipase C can comprise SEQ ID NO: 257.

In any of the methods that comprise applying a *Bacillus cereus* phosphatidylcholine-specific phospholipase C and a mannanase or a xyloglucanase, the mannanase can comprise SEQ ID NO: 307.

In any of the methods that comprise applying a *Bacillus cereus* phosphatidylcholine-specific phospholipase C and a mannanase or a xyloglucanase, the xyloglucanase can comprise SEQ ID NO: 299.

Amino acid sequences having a high degree of sequence identity to SEQ ID NO: 257, 307, and/or 299 can also be used. Thus, for example, the *Bacillus cereus* phosphatidylcholine-specific phospholipase C can comprise an amino acid sequence having at least 70%, at least 75%, at least 80%, at least 85%, at least 90%, at least 95%, at least 98%, at least 99%, or 100% identity to SEQ ID NO: 257; the mannanase can comprise an amino acid sequence having at least 70%, at least 75%, at least 80%, at least 85%, at least 90%, at least 95%, at least 98%, at least 99%, or 100% identity to SEQ ID NO: 307; and/or the xyloglucanase can comprise an amino acid sequence having at least 70%, at least 75%, at least 80%, at least 85%, at least 90%, at least 95%, at least 98%, at least 99%, or 100% identity to SEQ ID NP: 299.

In any of the methods wherein the fusion protein comprises a *Bacillus cereus* phosphatidylcholine-specific phospholipase C and the method further comprises applying a mannanase or a xyloglucanase, the mannanase or the xyloglucanase can also be part of a fusion protein. Where the mannanase or xyloglucanase is part of a fusion protein, the fusion protein can be co-expressed in the same recombinant *Bacillus cereus* family member as the phosphatidylcholine-specific phospholipase C. Alternatively or in addition, the method can comprise applying a second recombinant *Bacillus cereus* family member that expresses a fusion protein comprising the mannanase or the xyloglucanase.

Alternatively or in addition, in any of the methods wherein the fusion protein comprises a *Bacillus cereus* phosphatidylcholine-specific phospholipase C and the method further comprises applying a mannanase or a xyloglucanase, the mannanase or xyloglucanase can be in the form of a free enzyme.

In any of the methods wherein the fusion protein comprises a mannanase and the method further comprises applying a *Bacillus cereus* phosphatidylcholine-specific phospholipase C, the *Bacillus cereus* phosphatidylcholine-specific phospholipase C can also be part of a fusion protein. Where the *Bacillus cereus* phosphatidylcholine-specific phospholipase C is part of a fusion protein, the fusion protein can be co-expressed in the same recombinant *Bacillus cereus* family member as the mannanase. Alternatively or in addition, the method can comprise applying a second recombinant *Bacillus cereus* family member that expresses a fusion protein comprising the *Bacillus cereus* phosphatidylcholine-specific phospholipase C.

Alternatively or in addition, in any of the methods wherein the fusion protein comprises a mannanase and the method further comprises applying a *Bacillus cereus* phosphatidylcholine-specific phospholipase C, the *Bacillus cereus* phosphatidylcholine-specific phospholipase C can be in the form of a free enzyme.

In any of the methods wherein the fusion protein comprises a xyloglucanase and the method further comprises applying a *Bacillus cereus* phosphatidylcholine-specific phospholipase C, the *Bacillus cereus* phosphatidylcholine-specific phospholipase C can also be part of a fusion protein. Where the *Bacillus cereus* phosphatidylcholine-specific phospholipase C is part of a fusion protein, the fusion protein can be co-expressed in the same recombinant *Bacillus cereus* family member as the xyloglucanase. Alternatively or in addition, the method can comprise applying a second recombinant *Bacillus cereus* family member that expresses a fusion protein comprising the *Bacillus cereus* phosphatidylcholine-specific phospholipase C.

Alternatively or in addition, in any of the methods wherein the fusion protein comprises a xyloglucanase and the method further comprises applying a *Bacillus cereus* phosphatidylcholine-specific phospholipase C, the *Bacillus cereus* phosphatidylcholine-specific phospholipase C can be in the form of a free enzyme.

In any of the methods comprising applying a *Bacillus cereus* phosphatidylcholine-specific phospholipase C and a mannanase, the phospholipase C and the mannanase are preferably present in synergistically effective amounts.

In any of the methods comprising applying a *Bacillus cereus* phosphatidylcholine-specific phospholipase C and a xyloglucanase, the phospholipase C and the xyloglucanase are preferably present in synergistically effective amounts.

In any of the methods for stimulating plant growth and/or promoting plant health, the fusion protein can comprise a xyloglucanase and the method can further comprise applying a mannanase to the plant growth medium, plant, plant seed, or area surrounding the plant or the plant seed.

In any of the methods for stimulating plant growth and/or promoting plant health, the fusion protein can comprise a mannanase and the method can further comprise applying a xyloglucanase to the plant growth medium, plant, plant seed, or area surrounding the plant or the plant seed.

In any of the method comprising application of a xyloglucanase and a mannanase, the xyloglucanase can comprise SEQ ID NO: 299.

In any of the method comprising application of a xyloglucanase and a mannanase, the mannanase can comprise SEQ ID NO: 307.

Amino acid sequences having a high degree of sequence identity to SEQ ID NO: 299 and/or307 can also be used. Thus, the mannanase can comprise an amino acid sequence having at least 70%, at least 75%, at least 80%, at least 85%, at least 90%, at least 95%, at least 98%, at least 99%, or 100% identity to SEQ ID NO: 307; and/or the xyloglucanase can comprise an amino acid sequence having at least 70%, at least 75%, at least 80%, at least 85%, at least 90%, at least 95%, at least 98%, at least 99%, or 100% identity to SEQ ID NO: 299.

In any of the methods wherein the fusion protein comprises a xyloglucanase and the method further comprises applying a mannanase, the mannanase can also be part of a fusion protein. Where the mannanase is part of a fusion protein, the fusion protein can be co-expressed in the same recombinant *Bacillus cereus* family member as the xyloglucanase. Alternatively or in addition, the method can comprise applying a second recombinant *Bacillus cereus* family member that expresses a fusion protein comprising the mannanase.

Alternatively or in addition, in methods wherein the fusion protein comprises a xyloglucanase and the method further comprises applying a mannanase, the mannanase can be in the form of a free enzyme.

In any of the methods wherein the fusion protein comprises a mannanase and the method further comprises applying a xyloglucanase, the xyloglucanase can also be part of a fusion protein. Where the xyloglucanase is part of a fusion protein, the fusion protein can be co-expressed in the same recombinant *Bacillus cereus* family member as the mannanase. Alternatively or in addition, the method can comprise applying a second recombinant *Bacillus cereus* family member that expresses a fusion protein comprising the xyloglucanase.

Alternatively or in addition, in any of the methods wherein the fusion protein comprises a mannanase and the method further comprises applying a xyloglucanase, the xyloglucanase can be in the form of a free enzyme.

In any of the methods comprising applying a xyloglucanase and a mannanase, the xyloglucanase and the mannanase are preferably present in synergistically effective amounts.

In any of the methods for stimulating plant growth and/or promoting plant health, the fusion protein can comprise an acid phosphatase comprising SEQ ID NO: 311, and the method can further comprise applying an acid phosphatase comprising SEQ ID NO: 312 to the plant growth medium, plant, plant seed, or area surrounding the plant or the plant seed.

In any of the methods wherein the fusion protein comprises an acid phosphatase comprising SEQ ID NO: 311 and the method further comprises applying an acid phosphatase comprising SEQ ID NO: 312, the acid phosphatase comprising SEQ ID NO: 312 can also be part of a fusion protein. Wherein the acid phosphatase comprising SEQ ID NO: 312 is part of a fusion protein, the fusion protein can be co-expressed in the same recombinant *Bacillus cereus* family member as the acid phosphatase comprising SEQ ID NO: 311. Alternatively or in addition, the method can comprise applying a second recombinant *Bacillus cereus* family member that expresses a fusion protein comprising the acid phosphatase comprising SEQ ID NO: 312.

Alternatively or in addition, in any of the methods wherein the fusion protein comprises an acid phosphatase comprising SEQ ID NO: 311 and the method further comprises applying an acid phosphatase comprising SEQ ID NO: 312, the acid phosphatase comprising SEQ ID NO: 312 can be in the form of a free enzyme.

In any of the methods for stimulating plant growth and/or promoting plant health, the fusion protein can comprise an acid phosphatase comprising SEQ ID NO: 312, and the method can further comprise applying an acid phosphatase comprising SEQ ID NO: 311 to the plant growth medium, plant, plant seed, or area surrounding the plant or the plant seed.

In any of the methods wherein the fusion protein comprises an acid phosphatase comprising SEQ ID NO: 312 and the method further comprises applying an acid phosphatase comprising SEQ ID NO: 311, the acid phosphatase comprising SEQ ID NO: 311 can also be part of a fusion protein. Wherein the acid phosphatase comprising SEQ ID NO: 311 is part of a fusion protein, the fusion protein can be co-expressed in the same recombinant *Bacillus cereus* family member as the acid phosphatase comprising SEQ ID NO: 312. Alternatively or in addition, the method can comprise applying a second recombinant *Bacillus cereus* family member that expresses a fusion protein comprising the acid phosphatase comprising SEQ ID NO: 311.

Alternatively or in addition, in any of the methods wherein the fusion protein comprises an acid phosphatase comprising SEQ ID NO: 312 and the method further comprises applying an acid phosphatase comprising SEQ ID NO: 311, the acid phosphatase comprising SEQ ID NO: 311 can be in the form of a free enzyme.

Another method for stimulating plant growth and/or promoting plant health is provided. The method comprises applying a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a xylosidase, a histidine protease, an acid phosphatase, or a combination of any thereof.

Yet another method for stimulating plant growth and/or promoting plant health is provided. The method comprises applying exosporium fragments derived from spores of a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a xylosidase, a histidine protease, an acid phosphatase, or a combination of any thereof.

For example, the fusion protein can comprise a xylosidase.

Where the fusion protein comprises a xylosidase, the xylosidase can comprises a *Caldicellulosiruptor saccharolyticus* xylosidase, a *Bacillus pumilus* xylosidase, *Bacillus subtilis* xylosidase, or a combination thereof.

Where the fusion protein comprises a xylosidase, the xylosidase can comprise an amino acid sequence having at least 70% identity to any one of SEQ ID NOs. 274-276.

The xylosidase can comprise an amino acid sequence having at least 75% identity to any one of SEQ ID NOs. 274-276.

The xylosidase can comprise an amino acid sequence having at least 80% identity to any one of SEQ ID NOs. 274-276.

The xylosidase can comprise an amino acid sequence having at least 85% identity to any one of SEQ ID NOs. 274-276.

The xylosidase can comprise an amino acid sequence having at least 90% identity to any one of SEQ ID NOs. 274-276.

The xylosidase can comprise an amino acid sequence having at least 95% identity to any one of SEQ ID NOs. 274-276.

The xylosidase can comprise an amino acid sequence having at least 98% identity to any one of SEQ ID NOs. 274-276.

The xylosidase can comprise an amino acid sequence having at least 99% identity to any one of SEQ ID NOs. 274-276.

The xylosidase can comprise an amino acid sequence having 100% identity to any one of SEQ ID NOs. 274-276.

The fusion protein can comprise a histidine protease.

The fusion protein can comprise an acid phosphatase.

A further method for stimulating plant growth and/or promoting plant health is provided. The method comprises applying a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises an acid phosphatase. The method further comprises applying a second enzyme to the plant growth medium, the plant, the plant seed, or the area surrounding the plant or the plant seed.

Another method for stimulating plant growth and/or promoting plant health is provided. The method comprises applying exosporium fragments derived from spores of a recombinant *Bacillus cereus* expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises an acid phosphatase. The method further comprises applying a second enzyme to the plant growth medium, the plant, the plant seed, or the area surrounding the plant or the plant seed.

In any of the methods comprising applying a second enzyme to the plant growth medium, the plant, the plant seed, or the area surrounding the plant or the plant seed, the second enzyme suitably comprises a lipase, a phospholipase, a glucanase, a xylanase, a pectinase, a mannanase, a lichenase, a xylogluconase or a combination of any thereof.

In any of the methods wherein the fusion protein comprises an acid phosphatase, the acid phosphatase can comprise a *Triticum aestivum* acid phosphatase.

In any of the methods wherein the fusion protein comprises an acid phosphatase, the acid phosphatase can comprise amino acid sequence having at least 70% identity to SEQ ID NO: 311 or 312.

The acid phosphatase can comprise amino acid sequence having at least 75% identity to SEQ ID NO: 311 or 312.

The acid phosphatase can comprise amino acid sequence having at least 80% identity to SEQ ID NO: 311 or 312.

The acid phosphatase can comprise amino acid sequence having at least 85% identity to SEQ ID NO: 311 or 312.

The acid phosphatase can comprise amino acid sequence having at least 90% identity to SEQ ID NO: 311 or 312.

The acid phosphatase can comprise amino acid sequence having at least 95% identity to SEQ ID NO: 311 or 312.

The acid phosphatase can comprise amino acid sequence having at least 98% identity to SEQ ID NO: 311 or 312.

The acid phosphatase can comprise amino acid sequence having at least 99% identity to SEQ ID NO: 311 or 312.

The acid phosphatase can comprise amino acid sequence having at 100% identity to SEQ ID NO: 311 or 312.

A further method for stimulating plant growth and/or promoting plant health is provided. The method comprises applying a recombinant *Bacillus cereus* family member expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a phospholipase C. The method further comprises applying a second enzyme to the plant growth medium, the plant, the plant seed, or the area surrounding the plant or the plant seed.

Another method for stimulating plant growth and/or promoting plant health is provided. The method comprises applying exosporium fragments derived from spores of a recombinant *Bacillus cereus* expressing a fusion protein to a plant growth medium, a plant, a plant seed, or an area surrounding a plant or a plant seed. The fusion protein comprises a targeting sequence, exosporium protein, or exosporium protein fragment that targets the fusion protein to the exosporium of a recombinant *Bacillus cereus* family member. The fusion protein further comprises a phospholipase C. The method further comprises applying a second enzyme to the plant growth medium, the plant, the plant seed, or the area surrounding the plant or the plant seed.

In any of the methods wherein the fusion protein comprises a phospholipase C, the phospholipase C can comprise a *Bacillus thuringiensis* phospholipase C.

In any of the methods wherein the fusion protein comprises a phospholipase C, the phospholipase C can comprise an amino acid sequence having at least 70% identity to SEQ ID NO: 250 or SEQ ID NO: 251.

The phospholipase C can comprise an amino acid sequence having at least 75% identity to SEQ ID NO: 250 or SEQ ID NO: 251.

The phospholipase C can comprise an amino acid sequence having at least 80% identity to SEQ ID NO: 250 or SEQ ID NO: 251.

The phospholipase C can comprise an amino acid sequence having at least 85% identity to SEQ ID NO: 250 or SEQ ID NO: 251.

The phospholipase C can comprise an amino acid sequence having at least 90% identity to SEQ ID NO: 250 or SEQ ID NO: 251.

The phospholipase C can comprise an amino acid sequence having at least 95% identity to SEQ ID NO: 250 or SEQ ID NO: 251.

The phospholipase C can comprise an amino acid sequence having at least 98% identity to SEQ ID NO: 250 or SEQ ID NO: 251.

The phospholipase C can comprise an amino acid sequence having at least 99% identity to SEQ ID NO: 250 or SEQ ID NO: 251.

The phospholipase C can comprise an amino acid sequence having 100% identity to SEQ ID NO: 250 or SEQ ID NO: 251.

In any of the methods wherein the fusion protein comprises a phospholipase C, the phospholipase C can consist essentially of SEQ ID NO: 250 or SEQ ID NO: 251.

In any of the methods wherein the fusion protein comprises a phospholipase C, the phospholipase C can consist of SEQ ID NO: 250 or SEQ ID NO: 251.

In any of the methods comprising applying a second enzyme to the plant growth medium, the plant, the plant seed, or the area surrounding the plant or the plant seed, the second enzyme can comprise a xylogluconase or a mannanase.

When the second enzyme comprises a xylogluconase, the xylogluconase can comprise a *Paenibacillus pabuli* xylogluconase or a *Bacillus licheniformis* xylogluconase.

When the second enzyme comprises a xylogluconase, the xylogluconase can comprise an amino acid sequence having at least 70% identity to SEQ ID NO: 299 or 300.

The xylogluconase can comprise an amino acid sequence having at least 70% identity to SEQ ID NO: 299 or 300.

The xylogluconase can comprise an amino acid sequence having at least 75% identity to SEQ ID NO: 299 or 300.

The xylogluconase can comprise an amino acid sequence having at least 80% identity to SEQ ID NO: 299 or 300.

The xylogluconase can comprise an amino acid sequence having at least 85% identity to SEQ ID NO: 299 or 300.

The xylogluconase can comprise an amino acid sequence having at least 90% identity to SEQ ID NO: 299 or 300.

The xylogluconase can comprise an amino acid sequence having at least 95% identity to SEQ ID NO: 299 or 300.

The xylogluconase can comprise an amino acid sequence having at least 98% identity to SEQ ID NO: 299 or 300.

The xylogluconase can comprise an amino acid sequence having at least 99% identity to SEQ ID NO: 299 or 300.

The xylogluconase can comprise an amino acid sequence having 100% identity to SEQ ID NO: 299 or 300.

In the methods, the phospholipase C can comprise SEQ ID NO: 250 and the xylogluconase can comprise SEQ ID NO: 299. Alternatively, the phospholipase C can comprise SEQ ID NO: 250 and the xylogluconase can comprise SEQ ID NO: 300.

In any methods or formulations described herein comprising a phospholipase C and a second enzyme comprising a xylogluconase, the phospholipase C and the xylogluconase can be present in synergistically effective amounts.

When the second enzyme comprises a mannanase, the mannanase can comprise a *Bacillus circulans* mannanase or a *Bacillus subtilis* mannanase.

Alternatively or in addition, when the second enzyme comprises a mannanase, the mannanase can comprise an amino acid sequence having at least 70% identity to SEQ ID NO: 307 or 308.

The mannanase can comprise an amino acid sequence having at least 75% identity to SEQ ID NO: 307 or 308.

The mannanase can comprise an amino acid sequence having at least 80% identity to SEQ ID NO: 307 or 308.

The mannanase can comprise an amino acid sequence having at least 85% identity to SEQ ID NO: 307 or 308.

The mannanase can comprise an amino acid sequence having at least 90% identity to SEQ ID NO: 307 or 308.

The mannanase can comprise an amino acid sequence having at least 95% identity to SEQ ID NO: 307 or 308.

The mannanase can comprise an amino acid sequence having at least 98% identity to SEQ ID NO: 307 or 308.

The mannanase can comprise an amino acid sequence having at least 99% identity to SEQ ID NO: 307 or 308.

The mannanase can comprise an amino acid sequence having 100% identity to SEQ ID NO: 307 or 308.

In any of the formulations or methods described herein comprising a phospholipase C and a second enzyme comprising a mannanase, the phospholipase C can comprise SEQ ID NO: 250 and the mannanase can comprise SEQ ID NO: 308. Alternatively, the phospholipase C can comprise SEQ ID NO: 250 and the mannanase can comprise SEQ ID NO: 307.

In any of the formulations or methods described herein comprising a phospholipase C and a second enzyme comprising a mannanase, the phospholipase C and the mannanase can be present in synergistically effective amounts.

In any of the methods described herein, the method can further comprise inactivating the recombinant *Bacillus cereus* family member prior to applying the recombinant *Bacillus cereus* family member to the plant growth medium, the plant, the plant seed, or the area surrounding the plant or the plant seed.

In any of the methods described herein, the method can comprise applying the recombinant *Bacillus cereus* family member, the exosporium fragments, or the formulation to the plant growth medium.

In any of the methods described herein involving the use of a plant growth medium, the plant growth medium can comprise soil, water, an aqueous solution, sand, gravel, a polysaccharide, mulch, compost, peat moss, straw, logs, clay, soybean meal, yeast extract, or a combination thereof.

The plant growth medium can comprise a fertilizer.

The plant growth medium can consist essentially of a fertilizer.

Any of the methods described herein can further comprise supplementing the plant growth medium with a substrate for an enzyme. Suitable substrates include, but are not limited to tryptophan, an adenosine monophosphate, an adenosine diphosphate, an adenosine triphosphate (e.g., adenosine-3-triphosphate), a polyphosphate, a protein meal, a trimetaphosphate, a cellulose, a methylcellulose, a chitin, a chitosan, a cellulose derivative, a phosphate, a fat, a wax, a phospholipid, a phytic acid, or a combination of any thereof.

In any of the methods described herein, the method can comprise applying the recombinant *Bacillus cereus* family member, the exosporium fragments, or the formulation to the plant.

For example, the method can comprise applying the recombinant *Bacillus cereus* family member, the exosporium fragments, or the formulation to roots of the plant.

Alternatively or in addition, the method can comprise applying the recombinant *Bacillus cereus* family member, the exosporium fragments, or the formulation foliarly.

In any of the methods described herein, the method can comprise applying the recombinant *Bacillus cereus* family member, the exosporium fragments, or the formulation to the plant seed.

Where the method comprises applying the recombinant *Bacillus cereus* family member, the exosporium fragments, or the formulation to the plant seed, applying the recombinant *Bacillus cereus* family member, the exosporium fragments, or the formulation to the plant seed can comprise: (a) applying recombinant *Bacillus cereus* family member, the exosporium fragments, or the formulation to the plant seed at the time of planting; or (b) coating the plant seed with the recombinant *Bacillus cereus* family member, the exosporium fragments, or the formulation.

In any of the methods described herein, the method can further comprise applying an agrochemical to the plant growth medium, the plant, the plant seed, or the area surrounding the plant or the plant seed. Suitable agrochemicals are described below in Section IX.

In any of the methods described herein, the method can further comprise applying a fertilizer, a biostimulant, or a combination thereof to the plant growth medium, the plant, the plant seed, or the area surrounding the plant or the plant seed. Suitable fertilizers and biostimulants are described in Section IX below.

In any of the methods described herein, plants grown in the presence of the recombinant *Bacillus cereus* family member, the exosporium fragments, or the formulation can exhibit increased growth as compared to plants grown in the absence of the enzyme, the expansin protein, or the microorganism, under the same conditions.

In any of the methods described herein, seeds to which the recombinant *Bacillus cereus* family member, the exosporium fragments, or the formulation has been applied can exhibit increased germination rates as compared to seeds to which the enzyme or microorganism has not been applied, under the same conditions.

In any of the methods described herein, plants grown in the presence of the recombinant *Bacillus cereus* family member, the exosporium fragments, or the formulation can exhibit increased nutrient uptake as compared to plants grown in the absence of the enzyme, the expansin protein, or the microorganism, under the same conditions.

In any of the methods described herein, plants grown in the presence of the recombinant *Bacillus cereus* family member, the exosporium fragments, or the formulation can exhibit decreased susceptibility to a pathogen as compared to plants grown in the absence of the enzyme or the microorganism, under the same conditions.

In any of the methods described herein, plants grown in the presence of the recombinant *Bacillus cereus* family member, the exosporium fragments, or the formulation can exhibit decreased susceptibility to an environmental stress (e.g., drought, flood, heat, freezing, salt, heavy metals, low pH, high pH, or a combination of any thereof) as compared to plants grown in the absence of the enzyme or the microorganism, under the same conditions.

In any of the methods described herein, plants grown in the presence of the recombinant *Bacillus cereus* family member, the exosporium fragments, or the formulation can exhibit increased nutrient content as compared to plants grown in the absence of the enzyme, the expansin protein, or the microorganism, under the same conditions.

The nutrient can comprise, for example, a polysaccharide, a protein, phytic acid, a phosphatate, a phospholipid, or a combination of any thereof.

In any of the methods described herein, plants grown in the presence of the recombinant *Bacillus cereus* family member, the exosporium fragments, or the formulation exhibit can increased root nodulation as compared to plants grown in the absence of the enzyme or the microorganism, under the same conditions.

In any of the methods described herein, plants grown in the presence of the recombinant *Bacillus cereus* family member, the exosporium fragments, or the formulation can exhibit slower fruit ripening as compared to plants grown in the absence of the enzyme or the microorganism, under the same conditions.

In any of the methods described herein, plants grown in the presence of the recombinant *Bacillus cereus* family member, the exosporium fragments, or the formulation can exhibit greater crop yield as compared to plants grown in the absence of the enzyme, the expansin protein, or the microorganism, under the same conditions.

In any of the methods described herein, plants grown in the presence of the recombinant *Bacillus cereus* family member, the exosporium fragments, or the formulation can exhibit altered leaf senescence as compared to plants grown in the absence of the enzyme or the microorganism, under the same conditions.

VIII. Animal Feed Additives, Animal Feed Compositions, and Methods for Delivering an Enzyme to an Animal Feed enzymes provide a means to increase feed utilization and nutrition in agricultural animals. Enzymes can be used to increase animal performance and health benefits. In addition, the utilization of enzymes as feed additives can improve the utilization of feed by increasing the nutritive value of feed raw materials. The enzymes described herein, including, but not limited to phytases, xylanases, glucanases, xyloglucanases, mannanases, phospholipases, lichenases, xylosidases, pectolyases, phosphatases and lactonases can provide plant growth promoting properties to plants. These select enzymes are also useful feed additive enzymes that can be provided as a supplement to animal feed to increase animal performance and health benefits. Feed additive enzymes as described can be used to improve feed digestibility, thereby enhancing the efficiency of feed utilization. Improved feed utilization delivers to the animals a means to better utilize the plant nutrients obtained from feed sources such as cereals (barley, wheat, rye, oats, corn) and pasture forage grass or hays, such as alfalfa.

The enzymes described herein are particularly useful as feed additives because of their stability, which allows them to stay with the feed throughout the digestive process. The enzymes are also are not as easily absorbed across the epithelium (which would reduce their ability to continue to digest target substrates throughout the stomach and intestines as the conditions become more favorable to enzyme activity).

Any of the enzymes described herein can be used as feed additives provided on crop plants as a foliar treatment pre-harvest or as an over post-harvest spray treatment applied directly to the plant or plant part. Alternatively or in addition, any of the enzymes can be applied directly to vitamin and/or mineral premixes that are added to animal feed. Alternatively or in addition, the enzymes can be added in directly to the feed, either before, during, or after the feed has been processed. Supplied in any of these treatment types, the enzymes are useful for supporting gut health and performance in agricultural and companion animals including but not limited to poultry, swine, dairy and beef cattle, horses, goats, sheep, dogs, cats, fish, rabbits, rodents, and other, animal feed. Some of the advantages provided are lower feed costs and increased nutrient utilization and uptake, including the uptake of essential minerals and nutrients (e.g., calcium, zinc, cobalt, magnesium, iron). Increased nutrient utilization and uptake can inturn support increases in daily weight gain and overall animal health. Using enzymes as feed additives can also reduce feed costs and also generally improve the environmental impact for animal production.

One or more of the enzymes described herein can be used sequentially or simultaneously to provide enhanced nutritive benefits to an agricultural or companion animal. The enzymes as described are classified by the types of substrates that they work on. For instance, proteases break down proteins into amino acids making them more available for utilization and uptake by the animal if provided on a plant or feed derived from a plant or plant part.

Individual classes of enzymes that can be used as feed additives or in animal feed are further described below. These enzymes are useful to overcome limitations imposed on animal digestion due to the insufficiency of digestive enzymes that break down specific chemical linkages that bind and prevent the release of nutrients.

A. Phytases

Phytase is an enzyme that breaks down phytate molecules, a form of phosphorous found in plants that is not naturally available for the animal. Phytases therefore provide benefits by enhancing the release of available phosphorous, which in turn leads to increased animal growth. Phytase (e.g., the E246 phytase) allows the animal to absorb more phosphorus when provided on a plant or the plant part used for feed or in a feed additive.

B. Xylanases and Glucanases

Xylanase and glucanase break down non-starch polysaccharides, thereby releasing energy from the fibrous portion of grains and grain by-products. Glucanases break down the insoluble fraction of a feed crop, such as stalk tissues of corn fed to ruminant livestock such as dairy and beef cattle. Such corn stalk bales are usually provided as a supplemental feed to cattle during the winter months. Xylanases (e.g., the E100, E146, or E232 xylanases) and glucanases (e.g., the E94 glucanase) can be used to increase the feed quality of the bales by increasing the energy and nutrition that is provided to the animal. In addition, such enzymes can be added to corn stalk bales and used to reduce overall winter feed costs. Similarly, xylanases and glucanases can be used as feed additive enzymes on pasture forages (such as alfalfa) and other pasture grasses and hays.

C. Xyloglucanases

Xyloglucanse is an enzyme that breaks down xylgolucans (endo-hydrolysis of the 1,4-β-D-glucosidic linkages in xyloglucan). Xyloglucanases can also improve the overall hydrolysis of lignocellulosic materials. Xyloglucanases (e.g., the E149 and D381 xyloglucanases) can be used in the breakdown of polysaccharides thus releasing carbohydrates that are more utilizable to the animal.

D. Mannanases

Beta-mannanase is involved in the hydrolysis of terminal, non-reducing beta-D-mannose residues in beta-D-mannosides. Beta-mannanases (e.g., the E177 and E196 mannanases) can be used to improve production and performance when added to poultry and swine diets. Mannanase enzymes can be used as feed additive enzymes to enhance performance as measured by weight gain, feed conversion, and the overall health of poultry, swine and other animals.

E. Phospholipases

Phospholipases comprise a class of membrane-associated enzymes that cleave phospholipids just before the phosphate group. They can be used as dairy feed additives and supporting gut health and performance. In addition, phospholipases can be used to support the productivity of animals under stress, thus providing increased profitability.

Phospholipase C and phospholipase D enzymes are examples of phospholipases that are useful as feed additives. Phospholipase C (PLC) enzymes are capable of hydrolyzing phosphatidylinositol, resulting in a release of diacyl glycerol and inositol 1,4,5-trisphosphate ($IP_3$). Two examples of PLC enzymes are the E143 and E95 phosphilipases derived from *Bacillus thuringiensis* described herein. Additional examples of PLC enzymes include those from *Listeria* described herein. In particular, *Listeria monocytogenes* secretes a phosphatidylinositol-specific phospholipase C (PI-PLC). This enzyme can be expressed using a secretory signal and a propeptide sequence (ID Code D473), can be expressed with only with a propeptide (ID Code D474), or can be expressed without either the signal or propetide (ID Code D475). PI-PLC (e.g., E258) binds tightly to anionic phospholipids (such as those containing phosphomethyl head groups) and can form aggregated complexes with those anionic lipids and provided to animals for improved fat digestibility and as a nutritional supplement. Other phospholipases, such as phospholipase D (e.g., E229 and D409) where the principal substrate is phosphatidylcholine, hydrolyze phospholipids to produce the signal molecule phosphatidic acid (PA) and choline, which is a water-soluble vitamin-like nutrient and can be used to readily benefit animal nutrition.

F. Lichenases

Lichenase is an enzyme that hydrolyzes (1→4)-beta-D-glucosidic linkages in beta-D-D-glucans containing (1→3)- and (1→4)-bonds. Lichenases act on lichenin and cereal beta-D-glucans. Lichenin is a complex glucan or starch. Cereal feeds such as corn and other grains are used as a common feed source for many agricultural and companion animals. Lichenases (e.g., the E111 and D436 lichenases) that hydrolyze forms of beta glucans from cereals not only can provide a greater prebiotic quality to the cereal grains, but also can contribute an immunostimulating quality to the grain making it a beneficial food additive.

G. Xylosidase

Xylosidases catalyze the hydrolysis of short chain xylooligosaccharides from their non-reducing ends into xylose. More specifically, xylosidases (e.g., the E175 and E194 xylosidases) hydrolyze (1→4)-beta-D-xylans to remove the D-xylose residues from the non-reducing termini of the oligosaccharide. Xylosidases can also hydrolyzse xylobiose, a disaccharide of xylose monomers with a beta 1,4-bond between them. The resulting D-xylose is a pentose sugar obtained from the xylan-rich portion of hemicellulose, present in plant cell walls and fiber, can be used in animal feed and pet food to increase weight gain in animals under managed dietary regimes.

H. Pectolyase

Pectolyase is a pectinase, a type of enzyme that degrades pectin. Pectolyase (e.g., the E176 and D405 pectolyases) catalyzes the eliminative cleavage of alpha (α-(1-4)-D galacturonan methyl ester to give oligosaccharides with 4-deoxy-6-O-methyl-α-D-galact-4-enuronosyl groups at their non-reducing ends. Pectolyases are the only known pectinases capable of degrading highly esterified pectins (like those found in fruits) into small molecules and are capable of breaking down cell walls thus releasing the more energy-available polysaccharides that have functional roles in animal nutrition.

I. Acid Phosphatases

Acid Phosphatase (AcPC) is an enzyme that hydrolyzes organic phosphates at an acidic pH. Hydrolysis of phosphate esters is an important step in metabolism. Secreted AcPCs (e.g., the E252 AcPC) are relatively non-specific enzymes that appear to be important in the hydrolysis and mobilization of phosphorus from extracellular phosphomonoesters. Such enzymes can be used as a supplement for livestock and companion feed that is more nutritionally efficient by freeing up phosphorus.

J. Lactonase

Lactonases (also referred to as acyl-homoserine lactonases) are metalloenzymes. Lactonase (e.g., the H51 lactonase) hydrolyze the ester bond of the homoserine lactone ring of acylated homoserine lactones. In hydrolyzing the lactone bond, lactonase can prevent such signaling molecules from bacteria from binding to their target transcriptional regulators. Increasing the lactonase activity in feed additives can be beneficial for controlling bacterial infections in animals by inhibiting quorum-sensing activity.

K. Animal Feed Additives and Animal Feed Compositions Comprising Recombinant *Bacillus cereus* Family Members An animal feed additive is provided. The animal feed additive comprises any of the recombinant *Bacillus cereus* family members that expresses a fusion protein described herein. Alternatively, or in addition, the animal feed additive comprises exosporium fragments derived from any of the recombinant *Bacillus cereus* family member that expresses a fusion protein described herein.

An animal feed composition is provided. The animal feed composition comprises animal feed and any of the recombinant *Bacillus cereus* family members that expresses a fusion protein described herein. Alternatively, or in addition, the animal feed composition comprises animal feed and exosporium fragments derived from any of the recombinant *Bacillus cereus* family members that expresses a fusion protein described herein.

The animal feed additive or animal feed composition can further comprise a carrier suitable for injestion by a livestock or companion animal.

The carrier can comprise starch, polyvinyl alcohol, a dextrin, a limestone, sucrose, talc, cellulose, or a combination of any thereof.

When the carrier comprises dextrin, the dextrin can comprise maltodextrin, cyclodextrin, or a combination thereof.

For example, the carrier can comprise polyvinyl alcohol and cellulose.

The animal feed in the animal feed composition can comprise fodder.

When the animal feed comprises fodder, the fodder can comprise hay, straw, silage, a compressed feed, a pelleted feed, an oil, a grain, a sprouted grain, a legume (e.g., soybean), an insoluble fraction of a feedcrop (e.g., corn stalks), a crop residue, or a combination of any thereof.

"Crop residue" refers to materials left in an agricultural field or orchard after teh crop has been harvested (field residue) and materials left after the crop is processed (process residue). Crop residue includes, but is not limited to, stalks, stems, leaves, seed pods, husks, bagasse, molasses, roots, peels (e.g., banana peels), spent brewery material, and spent biofuel material. One example of crop residue that can be used in animal feed composition is the tops and leaves of sugarcane.

Alternatively, or in addition, the animal feed can comprise a cereal. For example, the cereal can comprise barley, wheat, rye, oats, corn, rice, millet, sorghum, or a combination of any thereof.

L. Methods for Delivering Enzymes to an Animal

A method for delivering an enzyme to an animal is provided. The method comprises feeding to the animal any of the recombinant *Bacillus cereus* family members that express any of the fusion proteins described herein. Alternatively or in addition, the method comprises feeding to the animal exosporium fragments derived from any of the recombinant *Bacillus cereus* family members that expresses any of the fusion proteins described herein.

The recombinant *Bacillus cereus* family member that expresses any fusion protein described herein can be provided in an animal feed additive or an animal feed composition. For example, the method can comprise feeding any of the animal feed additives or animal feed compositions described herein to the animal.

Alternatively, or in addition, the method can comprise applying the recombinant *Bacillus cereus* family member or the exosporium fragments to a plant, to a plant seed, or to a crop residue and feeding the plant, plant seed, or crop residue to the animal.

The method can comprise applying the recombinant *Bacillus cereus* family member or the exosporium fragments to the plant or plant seed prior to harvest. Alternatively, the method can comprise applying the recombinant *Bacillus cereus* family member or the exosporium fragments to the plant or plant seed after harvest.

The plant or plant seed can comprise a soybean, barley, wheat, rye, oat, rice, millet, sorghum, grass, or alfalfa plant or plant seed, or a combination of any thereof.

The animal can comprise a livestock animal or a companion animal. For example, the animal can comprise poultry, swine, cattle, a horse, a goat, a sheep, a dog, a cat, a fish, a rabbit, or a rodent.

IX. Carriers and Agrochemicals

As described above, the formulations described herein comprise an agriculturally acceptable carrier.

The agriculturally acceptable carrier can comprise a dispersant, a surfactant (e.g., a heavy petroleum oil, a heavy petroleum distillate, a polyol fatty acid ester, a polyethoxylated fatty acid ester, an aryl alkyl polyoxyethylene glycol, an alkyl amine acetate, an alkyl aryl sulfonate, a polyhydric alcohol, an alkyl phosphate, or a combination of any thereof), an additive (e.g., an oil, a gum, a resin, a clay, a polyoxyethylene glycol, a terpene, a viscid organic, a fatty acid ester, a sulfated alcohol, an alkyl sulfonate, a petroleum sulfonate, an alcohol sulfate, a sodium alkyl butane diamate, a polyester of sodium thiobutane dioate, a benzene acetonitrile derivative, a proteinaceous material, or a combination of any thereof), water, a thickener (a long chain alkylsulfonate of polyethylene glycol, a polyoxyethylene oleate, or a combination of any thereof), an anti-caking agent (e.g., sodium salt, a calcium carbonate, diatomaceous earth, or a combination of any thereof), a residue breakdown product, a composting formulation, a granular application, diatomaceous earth, an oil, a coloring agent, a stabilizer, a preservative, a polymer, a coating, or a combination of any thereof.

Where the agriculturally acceptable carrier comprises a surfactant, the surfactant can comprise a non-ionic surfactant.

Where the agriculturally acceptable carrier comprises an additive and the additive comprises a proteinaceous material, the proteinaceous material can comprise a milk product, wheat flour, soybean meal, blood, albumin, gelatin, alfalfa meal, yeast extract, or a combination of any thereof.

Where the agriculturally acceptable carrier comprises an anti-caking agent and the anti-caking agent comprises a sodium salt, the sodium salt can comprise a sodium salt of monomethyl naphthalene sulfonate, a sodium salt of dimethyl naphthalene sulfonate, a sodium sulfite, a sodium sulfate, or a combination of any thereof.

The agriculturally acceptable carrier can comprise vermiculite, charcoal, sugar factory carbonation press mud, rice husk, carboxymethyl cellulose, peat, perlite, fine sand, calcium carbonate, flour, alum, a starch, talc, polyvinyl pyrrolidone, or a combination of any thereof.

Any of the formulations described herein can comprise a seed coating formulation (e.g., an aqueous or oil-based solution for application to seeds or a powder or granular formulation for application to seeds), a liquid formulation for application to plants or to a plant growth medium (e.g., a concentrated formulation or a ready-to-use formulation), or a solid formulation for application to plants or to a plant growth medium (e.g., a granular formulation or a powder agent).

As described above, any of the formulations described herein can comprise an agrochemical.

Similarly, any of the methods described herein can further comprise applying an agrochemical to the plant growth medium, the plant, the plant seed, or the area surrounding the plant or the plant seed.

The agrochemical can comprise a fertilizer, a micronutrient fertilizer material, an insecticide, a nematicide, an herbicide, a plant growth amendment, a fungicide, an insecticide, a molluscicide, an algicide, a bacterial inoculant, a fungal inoculant, a plant hormone, or a combination of any thereof.

Where the agrochemical comprises a bacterial inoculant, the bacterial inoculant can comprise a plant-growth promoting strain of bacteria, an endophytic strain of bacteria, or a strain of bacteria that is both plant-growth promoting and endophytic. For example, the strain of bacteria can produce an insecticidal toxin (e.g., a Cry toxin), can produce a fungicidal compound (e.g., a β-1,3-glucanase, a chitosanase, a lyticase, or a combination of any thereof), can produce a nematicidal compound (e.g., a Cry toxin), can produce a bacteriocidal compound, can be resistant to one or more antibiotics, can comprise one or more freely replicating plasmid, can bind to plant roots, can colonize plant roots, can form biofilms, can solubilize nutrients, can secrete organic acids, or a combination of any thereof.

Where the agrochemical comprises a bacterial inoculant, the bacterial inoculant can comprise:

(a) *Bacillus aryabhattai* CAP53 (NRRL No. B-50819);
(b) *Bacillus aryabhattai* CAP56 (NRRL No. B-50817);
(c) *Bacillus flexus* BT054 (NRRL No. B-50816);
(d) *Paracoccus kondratievae* NC35 (NRRL No. B-50820);
(e) *Bacillus mycoides* BT155 (NRRL No. B-50921);
(f) *Enterobacter cloacae* CAP12 (NRRL No. B-50822);
(g) *Bacillus nealsonii* BOBA57 (NRRL No. B-50821);
(h) *Bacillus mycoides* EE118 (NRRL No. B-50918);
(i) *Bacillus subtilis* EE148 (NRRL No. B-50927);
(j) *Alcaligenes faecalis* EE107 (NRRL No. B-50920);
(k) *Bacillus mycoides* EE141 (NRRL NO. B-50916);
(l) *Bacillus mycoides* BT46-3 (NRRL No. B-50922);
(m) *Bacillus cereus* family member EE128 (NRRL No. B-50917);
(n) *Paenibacillus massiliensis* BT23 (NRRL No. B-50923);
(o) *Bacillus cereus* family member EE349 (NRRL No. B-50928);
(p) *Bacillus subtilis* EE218 (NRRL No. B-50926);
(q) *Bacillus megaterium* EE281 (NRRL No. B-50925);
(r) *Bacillus cereus* family member EE-B00377 (NRRL B-67119);
(s) *Bacillus pseudomycoides* EE-B00366 (NRRL B-67120);
(t) *Bacillus mycoides* EE-B00363 (NRRL B-67121);
(u) *Bacillus pumilus* EE-B00143 (NRRL B-67123);
(v) *Bacillus thuringiensis* EE-B00184 (NRRL B-67122);
(w) *Bacillus mycoides* EE116 (NRRL No. B-50919);
(x) *Bacillus cereus* family member EE417 (NRRL No. B-50974);
(y) *Lysinibacillus fusiformis* EE442 (NRRL No. B-50975);
(z) *Lysinibacillus sphaericus* EE443 (NRRL No. B-50976);
(aa) *Bacillus cereus* family member EE444 (NRRL No. B-50977);
(bb) *Bacillus subtilis* EE405 (NRRL No. B-50978);
(cc) *Bacillus cereus* family member EE439 (NRRL No. B-50979);
(dd) *Bacillus megaterium* EE385 (NRRL No. B-50980);
(ee) *Bacillus* species EE387 (NRRL No. B-50981);
(ff) *Bacillus circulans* EE388 (NRRL No. B-50982);
(gg) *Bacillus thuringiensis* EE319 (NRRL No. B-50983);
(hh) *Bacillus thuringiensis* BT013A (NRRL No. B-50924);

or a combination of any thereof.

Each of these strains has been deposited with the United States Department of Agriculture (USDA) Agricultural Research Service (ARS), having the address 1815 North University Street, Peoria, Illinois 61604 U.S.A., and are identified by the NRRL deposit numbers provided in parentheses. Strains (a)-(d), (f), and (g) were deposited on Mar. 7, 2013. Strains (e), (h)-(q), (w), and (hh) were deposited on Mar. 10, 2014. Strains (x)-(ff) were deposited on Sep. 10, 2014. Strain (gg) was deposited on Sep. 17, 2014. Strains (r)-(v) were deposited on Aug. 19, 2015. *Bacillus thuringiensis* BT013A is also known as *Bacillus thuringiensis* 4Q7.

It is hereby certified that the deposits were made in compliance with the terms of the Budapest Treaty and that: (i) during the pendency of this application, access to the deposited organisms will be afforded to the Commissioner upon request; (ii) all restrictions upon availability to the public of the deposited materials will be irrevocably removed upon granting of the patent, subject to 37 C.F.R. § 1.808(b); (iii) the deposit will be maintained for a period of 30 years or 5 years after the last request or for the effective life of the patent, whichever is longer; and (iv) the deposit will be replaced if it should ever become non-viable.

The isolation and characterization of these strains is described hereinbelow in the Examples. Partial 16S ribosomal RNA sequences for each of strains (e), (h), (k)-(m), (o), (r)-(t), (v)-(x), (aa), (cc), (gg), and (hh) are provided above in Table 18. Partial 16S ribosomal RNA sequences for each of strains (a)-(d), (f), (g), (i), (j), (n), (p), (q), (u), (y), (z), (bb), and (dd)-(ff) are provided in Table 21 below.

TABLE 21

Partial 16S ribosomal RNA sequences

| Strain | SEQ ID NO. for partial 16S ribosomal RNA sequence |
|---|---|
| *Bacillus megaterium* EE385 | 216 |
| *Bacillus* sp. EE387 | 217 |
| *Bacillus circulans* EE38 | 218 |
| *Bacillus subtilis* EE405 | 219 |
| *Lysinibacillus fusiformis* EE442 | 220 |
| *Lysinibcaillus sphaericus* EE443 | 221 |
| *Bacillus aryabhattai* CAP53 | 222 |
| *Bacillus aryabhattai* CAP56 | 223 |
| *Bacillus flexus* BT054 | 224 |
| *Paracoccus kondratievae* NC35 | 225 |
| *Enterobacter cloacae* CAP12 | 226 |
| *Bacillus nealsonii* BOBA57 | 227 |
| *Bacillus subtilis* EE148 | 228 |
| *Alcaligenes faecalis* EE107 | 229 |
| *Paenibacillus massiliensis* BT23 | 230 |
| *Bacillus subtilis* EE218 | 231 |
| *Bacillus megaterium* EE281 | 232 |
| *Bacillus pumilus* EE-B00143 | 233 |

Where the agrochemical comprises a fertilizer, the fertilizer can comprises a liquid or a dry fertilizer.

Where the agrochemical comprises a micronutrient fertilizer material, the micronutrient fertilizer material can comprises boric acid, a borate, a boron frit, copper sulfate, a copper frit, a copper chelate, a sodium tetraborate decahydrate, an iron sulfate, an iron oxide, iron ammonium sulfate, an iron frit, an iron chelate, a manganese sulfate, a manganese oxide, a manganese chelate, a manganese chloride, a manganese frit, a sodium molybdate, molybdic acid, a zinc sulfate, a zinc oxide, a zinc carbonate, a zinc frit, zinc phosphate, a zinc chelate, or a combination of any thereof.

Where the agrochemical comprises a fertilizer, the fertilizer can comprise ammonium sulfate, ammonium nitrate, ammonium sulfate nitrate, ammonium chloride, ammonium bisulfate, ammonium polysulfide, ammonium thiosulfate, aqueous ammonia, anhydrous ammonia, ammonium polyphosphate, aluminum sulfate, calcium nitrate, calcium ammonium nitrate, calcium sulfate, calcined magnesite, calcitic limestone, calcium oxide, calcium nitrate, dolomitic limestone, hydrated lime, calcium carbonate, diammonium phosphate, monoammonium phosphate, magnesium nitrate, magnesium sulfate, potassium nitrate, potassium chloride, potassium magnesium sulfate, potassium sulfate, sodium nitrates, magnesian limestone, magnesia, urea, urea-formaldehydes, urea ammonium nitrate, sulfur-coated urea, polymer-coated urea, isobutylidene diurea, $K_2SO_4$-2$MgSO_4$, kainite, sylvinite, kieserite, Epsom salts, elemental sulfur, marl, ground oyster shells, fish meal, oil cakes, fish manure, blood meal, rock phosphate, super phosphates, slag, bone meal, wood ash, manure, bat guano, peat moss, compost, green sand, cottonseed meal, feather meal, crab meal, fish emulsion, humic acid, or a combination of any thereof.

Where the agrochemical comprises an insecticide, the insecticide can comprises an organophosphate, a carbamate, a pyrethroid, an acaricide, an alkyl phthalate, boric acid, a borate, a fluoride, sulfur, a haloaromatic substituted urea, a hydrocarbon ester, a biologically-based insecticide, or a combination of any thereof.

Where the agrochemical comprises an herbicide, the herbicide can comprise a chlorophenoxy compound, a nitrophenolic compound, a nitrocresolic compound, a dipyridyl compound, an acetamide, an aliphatic acid, an anilide, a benzamide, a benzoic acid, a benzoic acid derivative, anisic acid, an anisic acid derivative, a benzonitrile, benzothiadiazinone dioxide, a thiocarbamate, a carbamate, a carbanilate, chloropyridinyl, a cyclohexenone derivative, a dinitroaminobenzene derivative, a fluorodinitrotoluidine compound, isoxazolidinone, nicotinic acid, isopropylamine, an isopropylamine derivative, oxadiazolinone, a phosphate, a phthalate, a picolinic acid compound, a triazine, a triazole, a uracil, a urea derivative, endothall, sodium chlorate, or a combination of any thereof.

Where the agrochemical comprises an herbicide, the herbicide can comprise 2,4-D, 2,4-DB, acetochlor, acifluorfen, alachlor, ametryn, atrazine, aminopyralid, benefin, bensulfuron, bensulide, bentazon, bromacil, bromoxynil, butylate, carfentrazone, chlorimuron, chlorsulfuron, clethodim, clomazone, clopyralid, cloransulam, cycloate, DCPA, desmedipham, dicamba, dichlobenil, diclofop, diclosulam, diflufenzopyr, dimethenamid, diquat, diuron, DSMA, endothall, EPTC, ethalfluralin, ethofumesate, fenoxaprop, fluazifop-P, flucarbazone, flufenacet, flumetsulam, flumiclorac, flumioxazin, fluometuron, fluroxypyr, fomesafen, foramsulfuron, glufosinate, glyphosate, halosulfuron, hexazinone, imazamethabenz, imazamox, imazapic, imazaquin, imazethapyr, isoxaben, isoxaflutole, lactofen, linuron, MCPA, MCPB, mesotrione, metolachlor-s, metribuzin, metsulfuron, molinate, MSMA, napropamide, naptalam, nicosulfuron, norflurazon, oryzalin, oxadiazon, oxyfluorfen, paraquat, pelargonic acid, pendimethalin, phenmedipham, picloram, primisulfuron, prodiamine, prometryn, pronamide, propanil, prosulfuron, pyrazon, pyrithiobac, quinclorac, quizalofop, rimsulfuron, sethoxydim, siduron, simazine, sulfentrazone, sulfometuron, sulfosulfuron, tebuthiuron, terbacil, thiazopyr, thifensulfuron, thiobencarb, tralkoxydim, triallate, triasulfuron, tribenuron, triclopyr, trifluralin, triflusulfuron, or a combination of any thereof.

Where the agrochemical comprises a fungicide, the fungicide can comprise a substituted benzene, a thiocarbamate, an ethylene bis dithiocarbamate, a thiophthalidamide, a copper compound, an organomercury compound, an organotin compound, a cadmium compound, anilazine, benomyl, cyclohexamide, dodine, etridiazole, iprodione, metlaxyl, thiamimefon, triforine, or a combination of any thereof.

Where the agrochemical comprises a fungicide, the fungicide can comprise aldimorph, ampropylfos, ampropylfos potassium, andoprim, anilazine, azaconazole, azoxystrobin, benalaxyl, benodanil, benomyl, benzamacril, benzamacrylisobutyl, bialaphos, binapacryl, biphenyl, bitertanol, blasticidin-S, boscalid, bromuconazole, bupirimate, buthiobate, calcium polysulphide, capsimycin, captafol, captan, carbendazim, carvon, quinomethionate, chlobenthiazone, chlorfenazole, chloroneb, chloropicrin, chlorothalonil, chlozolinate, clozylacon, cufraneb, cymoxanil, cyproconazole, cyprodinil, cyprofuram, debacarb, dichlorophen, diclobutrazole, diclofluanid, diclomezine, dicloran, diethofencarb, dimethirimol, dimethomorph, dimoxystrobin, diniconazole, diniconazole-M, dinocap, diphenylamine, dipyrithione, ditalimfos, dithianon, dodemorph, dodine, drazoxolon, edifenphos, epoxiconazole, etaconazole, ethirimol, etridiazole, famoxadon, fenapanil, fenarimol, fenbuconazole, fenfuram, fenitropan, fenpiclonil, fenpropidin, fenpropimorph, fentin acetate, fentin hydroxide, ferbam, ferimzone, fluazinam, flumetover, fluoromide, fluquinconazole, flurprimidol, flusilazole, flusulfamide, flutolanil, flutriafol, folpet, fosetyl-aluminium, fosetyl-sodium, fthalide, fuberidazole, furalaxyl, furametpyr, furcarbonil, furconazole, furconazole-cis, furmecyclox, guazatine, hexachlorobenzene, hexaconazole, hymexazole, imazalil, imibenconazole, iminoctadine, iminoctadine albesilate, iminoctadine triacetate, iodocarb, iprobenfos (IBP), iprodione, irumamycin, isoprothiolane, isovaledione, kasugamycin, kresoxim-methyl, copper preparations, such as: copper hydroxide, copper naphthenate, copper oxychloride, copper sulphate, copper oxide, oxine-copper and Bordeaux mixture, mancopper, mancozeb, maneb, meferimzone, mepanipyrim, mepronil, metconazole, methasulfocarb, methfuroxam, metiram, metomeclam, metsulfovax, mildiomycin, myclobutanil, myclozolin, nickel dimethyldithiocarbamate, nitrothal-isopropyl, nuarimol, ofurace, oxadixyl, oxamocarb, oxolinic acid, oxycarboxim, oxyfenthiin, paclobutrazole, pefurazoate, penconazole, pencycuron, phosdiphen, pimaricin, piperalin, polyoxin, polyoxorim, probenazole, prochloraz, procymidone, propamocarb, propanosine-sodium, propiconazole, propineb, prothiocinazole, pyrazophos, pyrifenox, pyrimethanil, pyroquilon, pyroxyfur, quinconazole, quintozene (PCNB), sulphur and sulphur preparations, tebuconazole, tecloftalam, tecnazene, tetcyclasis, tetraconazole, thiabendazole, thicyofen, thifluzamide, thiophanate-methyl, tioxymid, tolclofos-methyl, tolylfluanid, triadimefon, triadimenol, triazbutil, triazoxide, trichlamide, tricyclazole, tridemorph, trifloxystrobin, triflumizole, triforine, uniconazole, validamycin A, vinclozolin, viniconazole, zarilamide, zineb, ziram and also Dagger G, OK-8705, OK-8801, a-(1,1-dimethylethyl)-(3-(2-phenoxyethyl)-1H-1,2,4-triazole-1-ethanol, a-(2,4-dichlorophenyl)-[3-fluoro-3-propyl-1H-1,2,4-triazole-1-ethanol, a-(2,4-dichlorophenyl)-[3-methoxy-a-methyl-1H-1,2,4-triazole-1-ethanol, a-(5-methyl-1,3-dioxan-5-yl)[3-[[4-(trifluoromethyl)-phenyl]-methylene]-1H-1,2,4-triazole-1-ethanol, (5RS,6RS)-6-hydroxy-2,2,7,7-tetramethyl-5-(1H-1,2,4-triazol-1-yl)-3-octanone, (E)-a-(methoxyimino)-N-methyl-2-phenoxy-phenylacetamide, 1-isopropyl {2-methyl-1-[[[1-(4-methylphenyl)-ethyl]-amino]-carbonyl]-propyl}carbamate, 1-(2,4-dichlorophenyl)-2-(1H-1,2,4-triazol-1-yl)-ethanone-O-(phenyl methyl)-oxime, 1-(2-methyl-1-naphthalenyl)-1H-pyrrole-2,5-dione, 1-(3,5-dichlorophenyl)-3-(2-propenyl)-2,5-pyrrolidindione, 1-[(diiodomethyl)-sulphonyl]-4-methyl-benzene, 1-[[2-(2,4-dichlorophenyl)-1, 3-dioxolan-2-yl]-methyl]-1H-imidazole, 1-[[2-(4-chlorophenyl)-3-phenyloxiranyl]-methyl]-1H-1,2,4-triazole, 1-[1-[2-[(2,4-dichlorophenyl)-methoxy]-phenyl]-ethenyl]-1H-imidazole, 1-methyl-5-nonyl-2-(phenylmethyl)-3-pyrrolidinole, 2',6'-dibromo-2-methyl-4'-trifluoromethoxy-4'-trifluoro-methyl-1, 3-thiazole-carboxanilide, 2,2-dichloro-N-[1-(4-chlorophenyl)-ethyl]-1-ethyl-3-methyl-cyclopropanecarboxamide, 2,6-dichloro-5-(methylthio)-4-pyrimidinyl-thiocyanate, 2,6-dichloro-N-(4-trifluoromethylbenzyl)-benzamide, 2,6-dichloro-N-[[4-(trifluoromethyl)-phenyl]-methyl]-benzamide, 2-(2,3,3-triiodo-2-propenyl)-2H-tetrazole, 2-[(1-methylethyl)-sulphonyl]-5-(trichloromethyl)-1,3,4-thiadiazole, 2-[[6-deoxy-4-O-(4-0-methyl-(3-D-glycopyranosyl)-a-D-glucopyranos yl]-amino]-4-methoxy-1H-pyrrolo[2,3-d]pyrimidine-5-carbonitrile, 2-aminobutane, 2-bromo-2-(bromomethyl)-pentanedinitrile, 2-chloro-N-(2,3-dihydro-1,1,3-trimethyl-1H-inden-4-yl)-3-pyridinecarboxamide, 2-chloro-N-(2,6-dimethylphenyl)-N-(isothiocyanatomethyl)-acetamide, 2-phenylphenol (OPP), 3,4-dichloro-1-[4-(difluoromethoxy)-phenyl]-pyrrole-2,5-dione, 3,5-dichloro-N-[cyano[(1-methyl-2-propynyl)-oxy]-methyl]-benzamide, 3-(1,1-dimethylpropyl-1-oxo-1H-indene-2-carbonitrile, 3-[2-(4-chlorophenyl)-5-ethoxy-3-isoxazolidinyl]-pyridine, 4-chloro-2-cyano-N,N-dimethyl-5-(4-methylphenyl)-1H-imidazole-1-sulphonamide, 4-methyl-tetrazolo[1,5-a]quinazolin-5(4H)-one, 8-(1,1-dimethylethyl)-N-ethyl-N-propyl-1,4-dioxaspiro[4, 5]decane-2-methanamine, 8-hydroxyquinoline sulphate, 9H-xanthene-2-[(phenylamino)-carbonyl]-9-carboxylic hydrazide, bis-(1-methylethyl)-3-methyl-4-[(3-methylbenzoyl)-oxy]-2,5-thiophenedicarboxylate, cis-1-(4-chlorophenyl)-2-(1H-1,2,4-triazol-1-yl)-cycloheptanol, cis-4-[3-[4-(1,1-dimethylpropyl)-phenyl-2-methylpropyl]-2,6-dimethyl-morpholine hydrochloride, ethyl [(4-chlorophenyl)-azo]-cyanoacetate, potassium bicarbonate, methanetetrathiol-sodium salt, methyl 1-(2,3-dihydro-2,2-dimethyl-inden-1-yl)-1H-imidazole-5-carboxylate, methyl N-(2,6-dimethylphenyl)-N-(5-isoxazolylcarbonyl)-DL-alaninate, methyl N-(chloroacetyl)-N-(2,6-dimethylphenyl)-DL-alaninate, N-(2,3-dichloro-4-hydroxyphenyl)-1-methyl-cyclohexanecarboxamide, N-(2,6-dimethyl phenyl)-2-methoxy-N-(tetra hydro-2-oxo-3-furanyl)-acetamide, N-(2,6-dimethyl phenyl)-2-methoxy-N-(tetrahydro-2-oxo-3-thienyl)-acetamide, N-(2-chloro-4-nitrophenyl)-4-methyl-3-nitro-benzenesulphonamide, N-(4-cyclohexylphenyl)-1,4,5,6-tetrahydro-2-pyrimidinamine, N-(4-hexylphenyl)-1,4,5,6-tetrahydro-2-pyrimidinamine, N-(5-chloro-2-methylphenyl)-2-methoxy-N-(2-oxo-3-oxazolidinyl)-acetamide, N-(6-methoxy)-3-pyridinyl)-cyclopropanecarboxamide, N-[2,2,2-trichloro-1-[(chloroacetyl)-amino]-ethyl]-benzamide, N-[3-chloro-4,5-bis(2-propinyloxy)-phenyl]-N'-methoxy-methanimidamide, N-formyl-N-hydroxy-DL-alanine-sodium salt, 0,0-diethyl [2-(dipropylamino)-2-oxoethyl]-ethylphosphoramidothioate, O-methyl S-phenyl phenylpropylphosphoramidothioate, S-methyl 1,2,3-benzothiadiazole-7-carbothioate, and spiro [2H]-1-benzopyrane-2,1'(3'H)-isobenzofuran]-3'-one, N-trichloromethyl)thio-4-cyclohexane-1,2-dicarboximide, tetramethylthioperoxydicarbonic diamide, methyl N-(2,6-dimethylphenyl)-N-(methoxyacetyl)-DL-alaninate, 4-(2,2-difluoro-1,3-benzodioxol-4-yl)-1-H-pyrrol-3-carbonitril, or a combination of any thereof.

Where the agrochemical comprises a fungal inoculant, the fungal inoculant can comprise a fungal inoculant of the family Glomeraceae, a fungal inoculant of the family Claroidoglomeraceae, a fungal inoculant of the family Gigasporaceae, a fungal inoculant of the family Acaulosporaceae, a fungal inoculant of the family Sacculosporaceae, a fungal inoculant of the family Entrophosporaceae, a fungal inoculant of the family Pacidsporaceae, a fungal inoculant of the family Diversisporaceae, a fungal inoculant of the family Paraglomeraceae, a fungal inoculant of the family Archaeosporaceae, a fungal inoculant of the family Geosiphonaceae, a fungal inoculant of the family Ambisporaceae, a fungal inoculant of the family Scutellosporaceae, a fungal inoculant of the family Dentiscultataceae, a fungal inoculant of the family Racocetraceae, a fungal inoculant of the phylum Basidiomycota, a fungal inoculant of the phylum Ascomycota, a fungal inoculant of the phylum Zygomycota, or a combination of any thereof.

Where the agrochemical comprises a bacterial inoculant, the bacterial inoculant can comprise a bacterial inoculant of the genus *Rhizobium*, a bacterial inoculant of the genus *Bradyrhizobium*, a bacterial inoculant of the genus *Mesorhizobium*, a bacterial inoculant of the genus *Azorhizobium*, a bacterial inoculant of the genus *Allorhizobium*, a bacterial inoculant of the genus *Sinorhizobium*, a bacterial inoculant of the genus *Kluyvera*, a bacterial inoculant of the genus *Azotobacter*, a bacterial inoculant of the genus *Pseudomonas*, a bacterial inoculant of the genus *Azospirillium*, a bacterial inoculant of the genus *Bacillus*, a bacterial inoculant of the genus *Streptomyces*, a bacterial inoculant of the genus *Paenibacillus*, a bacterial inoculant of the genus *Paracoccus*, a bacterial inoculant of the genus *Enterobacter*, a bacterial inoculant of the genus *Alcaligenes*, a bacterial inoculant of the genus *Mycobacterium*, a bacterial inoculant of the genus *Trichoderma*, a bacterial inoculant of the genus *Gliocladium*, a bacterial inoculant of the genus *Glomus*, a bacterial inoculant of the genus *Klebsiella*, or a combination of any thereof.

Where the agrochemical comprises a bacterial inoculant and the bacterial inoculant comprises a bacterial inoculant of the genus *Bacillus*, the bacterial inoculant of the genus *Bacillus* can comprise *Bacillus argri, Bacillus aizawai, Bacillus albolactis, Bacillus amyloliquefaciens, Bacillus cereus, Bacillus coagulans, Bacillus endoparasiticus, Bacillus endorhythmos, Bacillus kurstaki, Bacillus lacticola, Bacillus lactimorbus, Bacillus lactis, Bacillus laterosporus, Bacillus lentimorbus, Bacillus licheniformis, Bacillus megaterium, Bacillus medusa, Bacillus metiens, Bacillus natto, Bacillus nigrificans, Bacillus popillae, Bacillus pumilus, Bacillus siamensis, Bacillus sphearicus, Bacillus* spp., *Bacillus subtilis, Bacillus thuringiensis, Bacillus unifagellatu*, or a combination of any thereof.

Where the agrochemical comprises a plant hormone, the plant hormone can comprise a gibberellin, an auxin, a kinetin, or a combination of any thereof.

Any of the formulations described herein can comprise a fertilizer, a biostimulant, or a combination thereof.

Likewise, any of the methods described herein can further comprise applying a fertilizer, a biostimulant, or a combination thereof to the plant growth medium, the plant, the plant seed, or the area surrounding the plant or the plant seed.

The fertilizer can comprise nitrogen, phosphate (e.g., monoammonium phosphate, diammonium phosphate, orthophosphate, orthopolyphosphate, or a combination of any thereof), potassium (e.g., potassium acetate), zinc, iron, selenium, boron, copper, or a combination of any thereof.

For example, the fertilizer can comprise 12% ammoniacal nitrogen and 58% available phosphate.

The biostimulant can comprises a gibberellic acid, an indole-3-butyric acid, a kinetin, an auxin, an auxin homolog or derivative, or a combination of any thereof.

Where the formulation comprises a fertilizer, a biostimulant, or a combination thereof, the fusion protein suitably comprises an acid phosphatase, a phospholipase, a mannanase, a glucanase, or a combination of any thereof.

Similarly, where the method further comprises applying a fertilizer, a biostimulant, or a combination thereof to the plant growth medium, the plant, the plant seed, or the area surrounding the plant or the plant seed, the fusion protein suitably comprises an acid phosphatase, a phospholipase, a mannanase, a glucanase, or a combination of any thereof.

X. Free Enzymes

Any of the enzymes described herein can also be used as free enzymes or as enzymes expressed in recombinant microorganisms in any of the methods, formulations, compositions, and plant seeds, described in U.S. Patent Application Publication No. US 2017/0356002 the contents of which are hereby incorporated by reference in their entirety.

XI. Plants

In any of the above methods relating to plants, the plant can be a dicotyledon, a monocotyledon, or a gymnosperm.

Likewise, for any of the seeds described herein the seed can be a seed of a dicotyledon, a monocotyledon, or a gymnosperm.

For example, where the plant is a dicotyledon or the seed is a seed of a dicotyledon, the dicotyledon can be selected from the group consisting of bean, pea, tomato, pepper, squash, alfalfa, almond, aniseseed, apple, apricot, arracha, artichoke, avocado, bambara groundnut, beet, bergamot, black pepper, black wattle, blackberry, blueberry, bitter orange, bok-choi, Brazil nut, breadfruit, broccoli, broad bean, Brussels sprouts, buckwheat, cabbage, camelina, Chinese cabbage, cacao, cantaloupe, caraway seeds, cardoon, carob, carrot, cashew nuts, cassava, castor bean, cauliflower, celeriac, celery, cherry, chestnut, chickpea, chicory, chili pepper, chrysanthemum, cinnamon, citron, clementine, clove, clover, coffee, cola nut, colza, corn, cotton, cottonseed, cowpea, crambe, cranberry, cress, cucumber, currant, custard apple, drumstick tree, earth pea, eggplant, endive, fennel, fenugreek, fig, filbert, flax, geranium, gooseberry, gourd, grape, grapefruit, guava, hemp, hempseed, henna, hop, horse bean, horseradish, indigo, jasmine, Jerusalem artichoke, jute, kale, kapok, kenaf, kohlrabi, kumquat, lavender, lemon, lentil, lespedeza, lettuce, lime, liquorice, litchi, loquat, lupine, macadamia nut, mace, mandarin, mangel, mango, medlar, melon, mint, mulberry, mustard, nectarine, niger seed, nutmeg, okra, olive, opium, orange, papaya, parsnip, pea, peach, peanut, pear, pecan nut, persimmon, pigeon pea, pistachio nut, plantain, plum, pomegranate, pomelo, poppy seed, potato, sweet potato, prune, pumpkin, quebracho, quince, trees of the genus Cinchona, quinoa, radish, ramie, rapeseed, raspberry, rhea, rhubarb, rose, rubber, rutabaga, safflower, sainfoin, salsify, sapodilla, Satsuma, scorzonera, sesame, shea tree, soybean, spinach, squash, strawberry, sugar beet, sugarcane, sunflower, swede, sweet pepper, tangerine, tea, teff, tobacco, tomato, trefoil, tung tree, turnip, urena, vetch, walnut, watermelon, yerba mate, wintercress, shepherd's purse, garden cress, peppercress, watercress, pennycress, star anise, laurel, bay laurel, cassia, jamun, dill, tamarind, peppermint, oregano, rosemary, sage, soursop, pennywort, calophyllum, balsam pear, kukui nut, Tahitian chestnut, basil, huckleberry, hibiscus, passionfruit, star apple, sassafras, cactus, St. John's wort, loosestrife, hawthorn, cilantro, curry plant, kiwi, thyme, zucchini, ulluco, jicama, waterleaf, spiny monkey orange, yellow mombin, starfruit, amaranth, wasabi, Japanese pepper, yellow plum, mashua, Chinese toon, New Zealand spinach, bower spinach, ugu, tansy, chickweed, jocote, Malay apple, paracress, sowthistle, Chinese potato, horse parsley, hedge mustard, campion, agate, cassod tree, thistle, burnet, star gooseberry, saltwort, glasswort, sorrel, silver lace fern, collard greens, primrose, cowslip, purslane, knotgrass, terebinth, tree lettuce, wild betel, West African pepper, yerba santa, tarragon, parsley, chervil, land cress, burnet saxifrage, honeyherb, butterbur, shiso, water pepper, perilla, bitter bean, oca, kampong, Chinese celery, lemon basil, Thai basil, water mimosa, cicely, cabbage-tree, moringa, mauka, ostrich fern, rice paddy herb, yellow sawah lettuce, lovage, pepper grass, maca, bottle gourd, hyacinth bean, water spinach, catsear, fishwort, Okinawan spinach, lotus sweetjuice, gallant soldier, culantro, arugula, cardoon, caigua, mitsuba, chipilin, samphire, mampat, ebolo, ivy gourd, cabbage thistle, sea kale, chaya, huauzontle, Ethiopian mustard, magenta spreen, good king henry, epazole, lamb's quarters, centella plumed cockscomb, caper, rapini, napa cabbage, mizuna, Chinese savoy, kai-lan, mustard greens, Malabar spinach, chard, marshmallow, climbing wattle, China jute, paprika, annatto seed, spearmint, savory, marjoram, cumin, chamomile, lemon balm, allspice, bilberry, cherimoya, cloudberry, damson, pitaya, durian, elderberry, feijoa, jackfruit, jambul, jujube, physalis, purple mangosteen, rambutan, redcurrant, blackcurrant, salal berry, satsuma, ugli fruit, azuki bean, black bean, black-eyed pea, borlotti bean, common bean, green bean, kidney bean, lima bean, mung bean, navy bean, pinto bean, runner bean, mangetout, snap pea, broccoflower, calabrese, nettle, bell pepper, raddichio, daikon, white radish, skirret, tat soi, broccolini, black radish, burdock root, fava bean, broccoli raab, lablab, lupin, sterculia, velvet beans, winged beans, yam beans, mulga, ironweed, umbrella bush, tjuntjula, wakalpulka, witchetty bush, wiry wattle, chia, beech nut, candlenut, colocynth, mamoncillo, Maya nut, mongongo, ogbono nut, paradise nut, and cempedak.

Where the plant is a monocotyledon or the seed is a seed of a monocotyledon, the monocotyledon can be selected from the group consisting of corn, wheat, oat, rice, barley, millet, banana, onion, garlic, asparagus, ryegrass, millet, fonio, raishan, nipa grass, turmeric, saffron, galangal, chive, cardamom, date palm, pineapple, shallot, leek, scallion, water chestnut, ramp, Job's tears, bamboo, ragi, spotless watermeal, arrowleaf elephant ear, Tahitian spinach, abaca, areca, bajra, betel nut, broom millet, broom sorghum, citronella, coconut, cocoyam, maize, dasheen, durra, durum wheat, edo, Pique, formio, ginger, orchard grass, esparto grass, Sudan grass, guinea corn, Manila hemp, henequen, hybrid maize, jowar, lemon grass, maguey, bulrush millet, finger millet, foxtail millet, Japanese millet, proso millet, New Zealand flax, oats, oil palm, palm palmyra, sago palm, redtop, sisal, sorghum, spelt wheat, sweet corn, sweet sorghum, taro, teff, timothy grass, triticale, vanilla, wheat, and yam.

Where the plant is a gymnosperm or the seed is a seed of a gymnosperm, the gymnosperm can be from a family selected from the group consisting of Araucariaceae, Boweniaceae, Brassicaceae, Cephalotaxaceae, Cupressaceae, Cycadaceae, Ephedraceae, Ginkgoaceae, Gnetaceae, Pinaceae, Podocarpaceae, Taxaceae, Taxodiaceae, Welwitschiaceae, and Zamiaceae.

When the plant is from the family Brassicaceae, the plant can comprise a plant of the genus *Brassica*. For example, the plant of the family Brassicaceae can comprise *Brassica napus, Brassica rapa, Brassica juncea, Brassica hirta, Brassica oleracea, Raphanus sativus, Sinapus alba,* or *Lepidium sativum*.

The plants and plant seeds described herein may include transgenic plants or plant seeds, such as transgenic cereals (wheat, rice), maize, soybean, potato, cotton, tobacco, oilseed rape and fruit plants (fruit of apples, pears, citrus fruits and grapes. Preferred transgenic plants include corn, soybeans, potatoes, cotton, tobacco and oilseed rape.

Suitable transgenic plants and seeds can be characterized by the plant's formation of toxins, especially from the Bacillus thuringiensis genetic material (e.g., by gene CryIA (a), CryIA (h), CryIA (c), CryIIA, CryIIIA, CryIIIB2, Cry9c, Cry2Ab, Cry3Bb, CryIF or a combination thereof). The formation of toxins in plants increases the plant's resistance to insects, arachnids, nematodes and slugs and snails (hereinafter referred to as "Bt plants"). Bt plants, for example, are commercially available under the tradename YIELD GARD (for example maize, cotton, soybeans), KnockOut® (for example maize), StarLink® (for example maize), Bollgard® (cotton), Nucotn® (cotton) and NewLeaf® (potato) maize varieties, cotton varieties, soybean varieties and potato varieties. Herbicide tolerance plants include plants under the trade names Roundup Ready® (a glyphosate tolerance, such as corn, cotton, soybeans), Clearfield® (for example maize), Liberty Link (tolerance with glufosinate, for example oilseed rape), IMI® (with imidazolinone tolerance) and STS® (tolerance to a sulfonylurea, such as maize).

Plant seeds as described herein can be genetically modified (e.g., any seed that results in a genetically modified plant or plant part that expresses herbicide tolerance, tolerance to environmental factors such as water stress, drought, viruses, and nitrogen production, or resistance to bacterial, fungi or insect toxins). Suitable genetically modified seeds include those of tole crops, vegetables, fruits, trees, fiber crops, oil crops, tuber crops, coffee, flowers, legume, cereals, as well as other plants of the monocotyledonous and dicotyledonous species. Preferably, the genetically modified seeds include peanut, tobacco, grasses, wheat, barley, rye, sorghum, rice, rapeseed, sugarbeet, sunflower, tomato, pepper, bean, lettuce, potato, and carrot. Most preferably, the genetically modified seeds include cotton, soybean, and corn (sweet, field, seed, or popcorn).

Particularly useful transgenic plants which may be treated according to the invention are plants containing transformation events, or a combination of transformation events, that are listed for example in the databases from various national or regional regulatory agencies (see for example gmoinfo.jrc.it/gmp_browse.aspx and www.agbios.com/dbase.php).

Having described the invention in detail, it will be apparent that modifications and variations are possible without departing from the scope of the invention defined in the appended claims.

EXAMPLES

The following non-limiting examples are provided to further illustrate the present invention. Additional examples, demonstrating the ability of various enzymes as described herein to stimulate plant growth and/or promote plant health when applied to plants as free enzymes, are included in U.S. Patent Application Publication No. US 2017/0356002 the contents of which are hereby incorporated by reference in their entirety.

Example 1: Use of Various Targeting Sequences to Express Lipase on the Surface of *Bacillus thuringiensis*

A wide variety of targeting sequences that that have a high degree of homology with amino acids 20-35 of BclA (amino acids 20-35 of SEQ ID NO: 1) can be used to display enzymes, proteins, and peptides on the surface of *Bacillus cereus* family members. Several targeting sequences were compared by making fusion proteins containing the targeting sequences linked to *Bacillus subtilis* lipase (the signal peptide of SEQ ID NO: 324, directly linked to the lipase of SEQ ID NO: 263). Fusion constructs were synthesized using the promoters native to the targeting sequence, cloned into the replicating plasmid pMK4, and introduced into *Bacillus thuringiensis* BT013A. *Bacillus thuringiensis* BT013A was deposited with the United States Department of Agriculture (USDA) Agricultural Research Service (ARS), having the address 1815 North University Street, Peoria, Illinois 61604 U.S.A., on Mar. 10, 2014, and assigned NRRL deposit number B-50924. *Bacillus thuringiensis* BT013A is also known as *Bacillus thuringiensis* 4Q7.

Strains were taken into sporulation by incubation at 30° C. on nutrient agar plates containing chloramphenicol 10 µg/ml for 3 days. Spores were collected, washed, and resuspended in PBS at a rate of $1 \times 10^8$/ml. $1 \times 10^5$ spores for each fusion construct were suspended in 400 µl dH$_2$O. The reactions were warmed with the reaction components to the desired reaction temperature (40° C.). 200 µl working buffer was added (9:1 Solution A: Solution B). Solution A was 50 mM Tris pH 10 and 13.6 mM deoxycholic acid and Solution B was 3 mg/ml p-nitrophenyl palmitate in isopropanol. The reaction was incubated at 40° C. for 10 minutes and placed on ice, centrifuged to remove spores, and absorbance at 420 nm was recorded. The results are shown in Table 22 below. Activity was normalized to a control fusion protein comprising amino acids 1-35 of SEQ ID NO: 1 fused to *Bacillus subtilis* lipase.

TABLE 22

| Strain | Targeting sequence | Enzyme | Relative activity |
|---|---|---|---|
| B. thuringiensis BT013A | Amino acids 1-35 of SEQ ID NO: 1 | Lipase | 100% |
| B. thuringiensis BT013A | Amino acids 1-27 of SEQ ID NO: 3 | Lipase | 92.5% |
| B. thuringiensis BT013A | Amino acids 1-28 of SEQ ID NO: 7 | Lipase | 13.5% |
| B. thuringiensis BT013A | Amino acid 1-24 of SEQ ID NO: 9 | Lipase | 24.8% |
| B. thuringiensis BT013A | Amino acid 1-33 of SEQ ID NO: 13 | Lipase | 98.5% |
| B. thuringiensis BT013A | Amino acid 1-33 of SEQ ID NO: 21 | Lipase | 107.8% |
| B. thuringiensis BT013A | SEQ ID NO: 96 | Lipase | 137.1% |
| B. thuringiensis BT013A | SEQ ID NO: 98 | Lipase | 146.3% |
| B. thuringiensis BT013A | SEQ ID NO: 100 | Lipase | 115.7% |
| B. thuringiensis BT013A | SEQ ID NO: 104 | Lipase | 81.5% |

Several targeting sequences linked to lipase result in higher expression levels and activity of enzyme on the surface of spores. In particular, SEQ ID NOs. 96, 98, and 100, each containing a shorter targeting sequence, resulted in enhanced fusion expression on the surface of the BEMD spores. All the fusion proteins containing targeting sequences tested resulted in surface display of lipase.

Example 2: Use of Various Exosporium Sequences to Express Lipase on the Surface of *Bacillus thuringiensis* and Demonstration of Fusion Protein Localization to the Exosporium Surface A wide variety of exosporium proteins can be used to display enzymes, proteins, and peptides on the surface of *Bacillus cereus* family members. Several different exosporium proteins were compared by making fusion proteins containing the exosporium proteins linked to *Bacillus subtilis* lipase as described in Example 1. Fusion constructs were synthesized using the promoter native to the exosporium protein indicated in Table 23 below, cloned into the replicating plasmid pMK4, and introduced into *Bacillus thuringiensis* BT013A. Spores displaying the various exosporium protein—*Bacillus subtilis* 168 lipase fusions were made by growing the transformed bacteria in brain heart infusion broth with selective pressure from 10 μg/ml chloramphenicol, plating onto nutrient agar plates, and incubating at 30° C. for 3 days. After 3 days, the spores were washed off the plates, purified by centrifugation, and resuspended in PBS at $1 \times 10^8$ CFU/ml.

$1 \times 10^5$ spores for each fusion construct were resuspended in 400 μl dH$_2$O. The reactions were warmed with the reaction components to the desired reaction temperature (40° C.). 200 μl of working buffer was added (9:1 Solution A: Solution B). Solution A was 50 mM Tris pH 10 and 13.6 mM deoxycholic acid and Solution B was 3 mg/ml p-nitrophenyl palmitate in isopropanol. The reaction was incubated at 40° C. for 10 minutes and placed on ice, centrifuged to remove spores and absorbance at 420 nm was recorded. Results are shown in Table 23 below. Activity was normalized to SEQ ID NO: 109 linked to lipase.

TABLE 23

| Strain | Exosporium protein | Enzyme | Relative activity |
|---|---|---|---|
| B. thuringiensis BT013A | SEQ ID NO: 109 | Lipase | 100% |
| B. thuringiensis BT013A | SEQ ID NO: 110 | Lipase | 134.5% |
| B. thuringiensis BT013A | SEQ ID NO: 113 | Lipase | 17.8% |
| B. thuringiensis BT013A | SEQ ID NO: 117 | Lipase | 19.8% |
| B. thuringiensis BT013A | SEQ ID NO: 118 | Lipase | 8.2% |

Use of the exosporium proteins of SEQ ID NOs. 109 and 110 resulted in the highest enzyme activity on the spore. All the fusion proteins containing exosporium proteins resulted in surface display of active *Bacillus subtilis* 168 lipase, albeit at different levels.

Additional exosporium proteins were demonstrated to result in targeting of fusion proteins to the exosporium using the fluorescent reporter mCherry. Fusion constructs were created that contained the exosporium proteins of SEQ ID NOs. 111, 120, and 110 linked to the mCherry reporter. Spores were grown for 1.5 days, collected, and resuspended as described above. 7 μl of fluorescent spores were put under a Nikon E1000 microscope and imaged during late sporulation. Circular localization in a ring is indicative of outer spore layer localization, and the appearance matches that of an exosporium protein. Fluorescent microscopy results are shown in FIG. 2. Panels A, B, and C of FIG. 2 are fluorescent microscopy images of spores expressing fusion proteins comprising the exosporium proteins of SEQ ID NOs. 111, 120, and 110, respectively, and the mCherry reporter. All three fusions demonstrated high levels of fluorescence and exosporium localization, demonstrating their potential utility for the expression of foreign proteins on the surface of the exosporium.

Example 3: Use of Various Targeting Sequences and Exosporium Proteins to Express Phosphatase in *Bacillus thuringiensis* Spores and Effects of the Phosphatase-Expressing Spores in Soybeans BEMD spores expressing *Bacillus subtilis* EE148 Phosphatase A4 (PhoA4) were created by gene synthesis of the genes coding for various targeting sequences and exosporium proteins under the control of their native promoters linked to PhoA4. The synthesized genes were cloned into pMK4 and introduced into *Bacillus thuringiensis* BT013A. Spores displaying the various exosporium protein—*Bacillus subtilis* EE148 PhoA4 fusions were made by growing the transformed bacteria in brain heart infusion broth with selective pressure from 10 μg/ml chloramphenicol, plating onto nutrient agar plates, and incubating at 30° C. for three days. After three days, the spores were washed off the plates, purified by centrifugation, and resuspended in PBS at $1 \times 10^8$ CFU/ml.

Soybeans were planted 2.54 cm deep in 10 cm deep pots filled with standard loam topsoil. BEMD spores expressing PhoA4 were diluted to a concentration of $1 \times 10^4$/ml in 50 ml of water and applied to each plant at planting. A water-only control was also included. Polyphosphate was added to pots in liquid at a rate of 0.5 mg/pot. Plants were grown under ideal light using T5 lamps, 54 watts, and exposed to 13 hours of light a day under controlled temperature conditions between 15.5-25.5° C. Plants were watered to saturation every three days over the two week trial. At the end of two weeks, the height of each plant was measured, and measurements were normalized to control water-only plants.

Results are shown in Table 24 below. Soy grown in the presence of BEMD spores expressing fusion proteins containing PhoA4 linked to various targeting sequences and exosporium proteins with different fusion partners with PhoA4 all exhibited enhanced growth, but the extent of the effect varied depending on the targeting sequence or exosporium protein used.

TABLE 24

| Bacillus species | Targeting sequence or exosporium protein linked to PhoA4 | Height at 2 weeks, Normalized |
|---|---|---|
| H$_2$O (No bacteria) | N/A | 100% |
| Bacillus thuringiensis BT013A | Amino acids 1-35 of SEQ ID NO: 1 | 100% |
| Bacillus thuringiensis BT013A | Amino acids 1-28 of SEQ ID NO: 3 | 117.4% |
| Bacillus thuringiensis BT013A | Amino acids 1-33 of SEQ ID NO: 21 | 107.3% |
| Bacillus thuringiensis BT013A | SEQ ID NO: 96 | 123.3% |
| Bacillus thuringiensis BT013A | SEQ ID NO: 98 | 124.1% |
| Bacillus thuringiensis BT013A | SEQ ID NO: 109 | 131.7% |
| Bacillus thuringiensis BT013A | SEQ ID NO: 110 | 104.8% |

Example 4: Use of Various Targeting Sequences to Express Endoglucanase on the Surface of *Bacillus cereus* Family Member Spores The pSUPER plasmid was generated through fusion of the pUC57 plasmid (containing an ampicillin resistance cassette) with the pBC16-1 plasmid from *Bacillus* (containing a tetracycline resistance). This 5.5 kbp plasmid can replicate in both *E. coli* and *Bacillus* spp. The pSUPER plasmid was modified by cloning of a PCR generated fragment through homologous recombination that fused the BclA promoter, start codon, and amino acids 20-35 of BclA (amino acids 20-35 of SEQ ID NO: 1) in frame with *Bacillus subtilis* 168 endoglucanase (the signal peptide of SEQ ID NO: 334, directly linked to the β-1,4-endoglucanase of SEQ ID NO: 293; pSUPER-BclA 20-35-Endo). PCR fragments were generated that contained the BclA promoter (SEQ ID NO: 149), start codon, and amino acids 20-35 of BclA fused in frame to *Bacillus subtilis* 168 endoglucanase. These PCR fragments were digested with XhoI and ligated into the SalI site of the pSUPER plasmid to generate the plasmid pSUPER-BclA 20-35-Endoglucanase. This plasmid was then subjected to inverse PCR to amplify the entire plasmid backbone, but leaving out the sequence corresponding to amino acids 20-35 of BclA. This inverse PCR product was combined with a PCR product that amplified the equivalent region from each of SEQ ID NOs. 5, 15, 25, 81, 85, 87, or amino acids 20-33 of SEQ ID NO: 1. Thus, constructs were created that contained each of the following targeting sequences fused in frame with *Bacillus subtilis* 168 endoglucanase: (1) amino acids 20-35 of SEQ ID NO: 1; (2) amino acids 23-38 of SEQ ID NO: 5; (3) amino acids 28-43 of SEQ ID NO: 15; (4) amino acids 9-24 of SEQ ID NO: 25; (5) amino acids 23-38 of SEQ ID NO: 81; (6) amino acids 13-28 of SEQ ID NO: 85; (7) amino acids 13-28 of SEQ ID NO: 87; and (8) amino acids 20-33 of SEQ ID NO: 1. Each construct contained the wildtype BclA promoter and a methionine at the start codon, followed by the targeting sequence fused in frame to the *Bacillus subtilis* endoglucanase gene. Each of these constructs was transformed into *E. coli* and plated to obtain single colonies on Luria plates plus ampicillin (100 μg/ml). Plasmids from each single colony were grown up in overnight cultures in Luria broth plus ampicillin, and purified using a WIZARD SV miniprep kit, and sequences were verified by Sanger sequencing. DNA was also quantified via spectrophotometry, and the DNA was introduced into *Bacillus thuringiensis* BT013A. In addition, the pSUPER-BclA-20-35 Endo construct was introduced into *Bacillus thuringiensis* BT013A which had the native BclA protein removed from its genome through homologous recombination (BclA knockout, "BclA KO"). Correct colonies were screened by plating on nutrient broth plate containing antibiotic (tetracycline at 10 μg/ml). Each positive colony was grown up in brain heart infusion broth at 30° C. overnight at 300 rpm, with antibiotic, and genomic DNA was purified and re-sequenced to verify genetic purity. Verified colonies were grown overnight in brain heart infusion broth with 10 μg/ml tetracycline, and induced to sporulate through sporulation in a yeast extract-based media.

Each of the production runs in the yeast extract-based media were collected at 48 hours post production of spores, and subjected to enzyme comparison of the resultant spores. The assay for endoglucanase activity was performed by determining cellulase activity using a carboxymethylcellulose (CMC) substrate and a dinitrosalicylic acid (DNS reagent). A commercial source of cellulase enzyme was used to prepare standards in 50 mM citrate buffer, pH 4.8. 1% CMC (carboxymethylcellulose sodium salt) was prepared in 50 mM citrate buffer, pH 4.8, to serve as the substrate for the reaction. 250 μl of spore preparation was pelleted and the spores were resuspended in 150 μL of 50 mM citrate buffer, pH 4.8. The reaction was carried out with a reagent composed of 1% DNS, 1% NaOH, 0.05% $Na_2SO_4$, 0.2% phenol, and 18.2% Rochelle salts. 150 μl of the sample was mixed with 250 μl of the 1% CMC substrate and incubated in a water bath at 50° C. for 15 minutes. 300 μl of DNS reagent was added and the samples boiled at 100° C. for 10 minutes and then cooled on ice. The solution was centrifuged for 5 minutes at 14,000×g to remove the spores from the absorbance reading. The absorbance was determined at 540 nm using an IMPLEN nanospectrophotometer model P330. Samples were performed in triplicate with a blank for each reaction. The results from the enzyme readings are shown in Table 25.

For corn, 1 μl of each of the whole broth for each of the constructs was placed onto each seed. For summer squash, 2 μl of whole broth for each construct was placed onto each seed. To accomplish this, 50 seeds were placed in a 50 ml conical bottom polypropylene tube and vortexed lightly using a vortex mixer. To this swirling of seeds, 50 μl (for corn) or 100 μl (for squash) of broth containing the recombinant spores was slowly pipetted into the tube, and the vortexing action coated the seeds with an even coating of the whole cell broth from each construct. These seeds were then planted at 1" deep into native soil using a 39.6 $cm^3$ (15.6 $in^3$) planting pot, with two seeds per pot. The pots were then watered to saturation, and the plants allowed to germinate. The plants were grown in a controlled growth room, set to 70° F. during the day, and 60° F. during the evening, with a light period of 14 hours/day, under artificial light conditions, for 14 days. After 14 days, the plants were measured for height, and results were normalized to a control group that received only water as treatment on the seeds.

TABLE 25

Enzyme levels and plant growth phenotypes.

| Targeting Sequence | Endo Enzyme Levels (mU/ml) | Sequence Identity to AA 20-35 of BclA | Sequence Identity to AA 25-35 of BclA | Corn Growth Phenotype | Squash Growth Phenotype | Average Plant Phenotype Change |
|---|---|---|---|---|---|---|
| Control ($H_2O$) | 0 mU/ml | N/A | N/A | 100% | 100% | 100% |
| AA 20-35 of BclA (SEQ ID NO: 1) | 38.2 | 100% | 100% | 112% | 94.7% | 103.4% |
| AA 23-38 of SEQ ID NO: 5 | 33.5 | 50.0% | 72.7% | 106.7% | 102.3% | 104.5% |
| AA 28-43 of SEQ ID NO: 15 | 16.7 | 68.8% | 81.8% | 115.7% | 103.4% | 109.6% |
| AA 9-24 of SEQ ID NO: 25 | 25.7 | 56.3% | 63.6% | 118.4% | 107.1% | 112.8% |
| AA 23-38 of SEQ ID NO: 81 | 21.5 | 50.0% | 72.7% | 106.7% | 98.3% | 102.5% |
| AA 13-28 of SEQ ID NO: 85 | 38.3 | 43.8% | 54.5% | 99.7% | 100.5% | 100.1% |
| AA 13-28 of SEQ ID NO: 87 | 14.4 | 43.8% | 54.5% | 102.6% | 104.1% | 103.4% |
| AA 20-33 of SEQ ID NO: 1 | 30.5 | N/A | 100% | 104.6% | 100.7% | 102.7% |

TABLE 25-continued

Enzyme levels and plant growth phenotypes.

| Targeting Sequence | Endo Enzyme Levels (mU/ml) | Sequence Identity to AA 20-35 of BclA | Sequence Identity to AA 25-35 of BclA | Corn Growth Phenotype | Squash Growth Phenotype | Average Plant Phenotype Change |
|---|---|---|---|---|---|---|
| AA 20-35 of SEQ ID N

TABLE 27

Phospholipase Enzyme levels

| Targeting Sequence | PC-PLC Enzyme Levels (relative to H₂O control) | Lipase Enzyme Levels (relative to H₂O control) |
|---|---|---|
| Control (H₂O) | 0.0 | 0.0 |
| AA20-35 SEQ ID NO: 1 | .787 | .436 |
| AA 23-38 of SEQ ID NO: 5 | .688 | .602 |
| AA 28-43 of SEQ ID NO: 15 | .372 | .228 |
| AA 9-24 of SEQ ID NO: 25 | .247 | .359 |
| SEQ ID NO: 114 | .446 | .798 |
| SEQ ID NO: 120 | 3.612 | .753 |
| SEQ ID NO: 111 | .738 | .329 |

AA = Amino acids

Similar to the results shown above in Table 26, the highest levels of phospholipase or lipase on the spore surface were observed when amino acids 20-35 of SEQ ID NO: 1, amino acids 23-38 of SEQ ID NO: 5, or the exosporium protein sequence of SEQ ID NO: 120 were used.

The effects of spores expressing the BclA 20-35-PL construct on nodulation in soybeans are shown below in Table 28.

TABLE 28

Phospholipase Plant Responses

| Targeting Sequence | Nodulation per Plant (Soybean) |
|---|---|
| Control (H₂O) | 9.8 |
| Strain Control (Bacillus thuringiensis BT013A) | 8.2 |
| Bacillus thuringiensis BT013A expressing a fusion protein of AA 20-35 of SEQ ID NO: 1 and phospholipase | 14.0 |

Spores expressing the 20-35-PL construct and non-transformed spores were applied to soybean seed using 1 µL volumes of spore preparations and a spore concentration of $1.8$-$1.9 \times 10^8$ spores per mL (from cultures that resulted in approximately 99% sporulation). Seeds were treated before planting by pipetting 1 µL of the spore preparation directly onto each seed and allowing it to dry. Nodulation was examined after about three weeks, at the V3 stage of development. Plants were carefully removed, dirt washed gently off of the roots, and nodules counted for each plant. As shown in Table 28, addition of spores displaying phospholipase onto the seeds of soybean allows for an accelerated number of nodules on the plants, which is a positive indication for both early growth as well as eventual increases in yield in soybeans.

Example 6: Enhanced Expression of Fusion Constructs on the BEMD System by Use of Enhanced or Alternative Promoter Elements The BEMD system can display a wide range of proteins, peptides, and enzymes using one or more of the targeting sequences described herein. Some of these targeting sequences have a high affinity for the exosporium which would be beneficial for fusion protein expression, but their low fusion protein expression level limits their use on the BEMD system. For such fusion proteins and sequences, alternative high-expression sporulation promoters can be used instead of the native promoters.

For example, SEQ ID NO: 13 (amino acids 1-39 of B. weihenstephensis KBAB4 gene 3572) provides a very effective N-terminal sequence for the delivery of proteins to the exosporium of Bacillus cereus family members, as shown in Table 29 below. All genes were synthesized in their complete form (including promoter regions and regions coding for fusion proteins) as described herein. When the native promoter elements for B. weihenstephensis KBAB4 gene 3572 (SEQ ID NO: 177) were used to express a fusion protein comprising the targeting sequence of SEQ ID NO: 13 fused to a β-galactosidase enzyme (from E. coli), a low level of fusion protein was expressed, leading to a reduction in enzyme activity on the surface of the spore. Enzyme activity was measure by the conversion of 0.5M o-nitrophenylgalactoside in solution over 10 minutes. Enzyme conversion was measured with a spectrophotometer at $ABS_{540}$. Replacement of the native promoter elements of the B. weihenstephensis KBAB4 gene 3572 with the high-expression promoters of SEQ ID NO: 157 (B. anthracis BetA/BAS3290) or SEQ ID NO: 178 (B. weihenstephensis KBAB4 YVTN β-propeller protein) led to a dramatic increase in the enzymatic activity of the spores. On the other hand, replacement of the native promoter elements for B. weihenstephensis KBAB4 gene 3572 with the promoter native to B. anthracis Sterne BAS1882 (SEQ ID NO: 176) led to a decrease in the enzymatic activity of the spores. The expression level of the targeting sequence of SEQ ID NO: 13 fused to β-galactosidase was much lower (0.38×) when driven by the promoter of BAS1882 (SEQ ID NO: 176), and was greatly improved when driven from the BetA promoter (SEQ ID NO: 197) or YVTN protein promoter (SEQ ID NO: 178).

TABLE 29

| Promoter | Fusion Protein | β-galactosidase activity on BEMD system, normalized | Fold Change |
|---|---|---|---|
| SEQ ID NO: 177 | SEQ ID NO: 13 - β-galactosidase | 100% | |
| SEQ ID NO: 157 | SEQ ID NO: 13 - β-galactosidase | 213.4% | 2.13X |
| SEQ ID NO: 178 | SEQ ID NO: 13 - β-galactosidase | 220.7% | 2.21X |
| SEQ NO: ID 176 | SEQ ID NO: 13 - β-galactosidase | 38.1% | 0.38X |

Example 7: Expression Levels of Fusion Proteins Using Various Sigma-K Containing Promoters As shown in Example 6 above, replacing the native promoter of a targeting sequence, exosporium protein, or exosporium protein fragment can greatly affect the level of fusion protein expressed on the exosporium of a Bacillus cereus family spore. For example, replacing the native BclA promoter with the BclB promoter greatly reduces the level of fusion protein on the surface of Bacillus cereus family member spores. Alternatively, replacement of native BclB promoter with the BclA promoter increases fusion protein levels on the exosporium dramatically.

Relative promoter expression levels for various exosporium proteins under the control of their native sporulation promoters were obtained from microarray data from Bergman et al., *Transcriptional profiling of the Bacillus anthracis life cycle in vitro and an implied model for regulation of spore formation*, J. Bacteriol. 188(17): 6092-6100 (2006).

The relative expression levels were determined during late sporulation timing (300 minutes after the start of the experiment), when sigma K promoters are most active. Sigma K promoters are important promoters for expression of exosporium localized genes and associated proteins. Relative expression is the increase in a gene's expression level when compared to the average of all other genes of the chromosome at all given times. Table 30 below shows the relative expression levels of a variety of sigma K driven genes in *Bacillus cereus* family members.

TABLE 30

| Protein (Promoter SEQ ID NO.) | Relative Expression (Fold increase in mRNA) |
|---|---|
| CotO (SEQ ID NO: 186) | 79.21 |
| Rhamnose (SEQ ID NO: 185) | 75.69 |
| BclC (SEQ ID NO: 139) | 14.44 |
| Sigma K (SEQ ID NO: 187) | 64 |
| BclA adjacent US Glycosyl transferase promoter 1 (SEQ ID NO: 189) | 72.25 |
| BclA adjacent DS Glycosyl transferase promoter 2 (SEQ ID NO: 190) | 73.96 |
| BclA (SEQ ID NO: 175) | 77.44 |
| ExsY (SEQ ID NO: 180) | 32.49 |
| YjcA (SEQ ID NO: 182) | 64 |
| YjcB (SEQ ID NO: 183) | 70.56 |
| BxpB/ExsFA (SEQ ID NO: 184) | 30.25 |
| InhA (SEQ ID NO: 188) | 34.25 |

Example 8: Preparation of Exosporium Fragments from Recombinant *Bacillus cereus* Family Members Comprising a Knockout of the CotE Gene The plasmid pUCpE was constructed that contained the pUC19 backbone, which is able to replicate in *E. coli*, as well as the origin of replication erythromycin resistance cassette from pE194. This construct is able to replicate in both *E. coli* and *Bacillus* spp. A 1 kb DNA region corresponding to the upstream region of the CotE gene and a 1 kb region corresponding to the downstream region of the gene CotE were PCR amplified from *Bacillus anthracis* ΔSterne. The two 1 kb regions were then spliced together using splicing by overlapping extension via 15 bp homologous overhangs that corresponded to the opposing PCR amplicons. This 2 kb fragment was digested with XhoI (in external primers) and ligated into the SalI site of pUCpE. This plasmid construct was verified by digestion and DNA sequencing. A Gram-positive omega-kanamycin resistance gene was digested with BamHI and placed between the two 1-kb regions. The final construct was again PCR verified and sequenced, and the final plasmid was introduced into *Bacillus anthracis* ΔSterne. Correct clones were screened by looking for both erythromycin resistance and kanamycin resistance.

Clones were passaged under high temperature (40° C.) in brain heart infusion broth in the presence of kanamycin (25 µg/ml) and were routinely struck for isolation onto LB agar plates containing kanamycin and grown at 30° C. Individual colonies were toothpicked onto LB agar plates containing erythromycin 5 µg/ml and grown at 30° C. Clones that maintained kanamycin resistance but lost erythromycin resistance (signifying loss of the plasmid but recombination and removal of the CotE gene) were grown in brain heart infusion broth plus kanamycin, and chromosomal DNA was isolated using a Qiagen Chromosomal DNA isolation kit. Proper deletion of the CotE gene was determined by PCR amplification of the CotE gene region and loss of CotE, and gain of the kanamycin resistance cassette.

A construct was generated (pHP13-AcpC-eGFP) that encoded the exosporium protein AcpC (acid phosphatase) fused in frame to the fluorescent reporter protein eGFP (enhanced green fluorescent protein). The pHP13-AcpC-eGFP construct included the native AcpC promoter, ribosomal binding site, and coding sequence for AcpC (from *B. anthracis* ΔSterne), fused in frame to eGFP (from pGFPuv). This construct was generated by PCR amplification of the individual AcpC and eGFP genes with corresponding primers that contained a 15 bp overlapping region corresponding to the alternate amplicons. The two PCR amplicons were then purified, and combined into a second PCR reaction using external primers that contained XhoI sites. The two amplicons prime each other with their compatible ends, and create fusion PCR amplicons. The fusion PCR amplicons were purified and digested with XhoI for 1 hour at 37° C. The spliced PCR product was cloned into the SalI site of pHP13, and correct clones were sequence verified and transformed into SCS110 *E. coli*. The plasmid DNA was subsequently isolated from the *E. coli* and introduced into *B. anthracis* ΔSterne CotE::Kan, generated as described above, which was grown in brain heart infusion broth containing 10 µg/ml chloramphenicol overnight at 30° C. One milliliter of this culture was inoculated into nutrient broth (50 ml) in a baffled flask and grown at 30° C. for 3 days. Spores were collected via centrifugation at 10,000×g for 5 minutes, and the supernatant (containing the broken exosporium fragments) was filtered through a 100,000 Da membrane filter to obtain purified exosporium fragments containing the fusion proteins.

Figure 3:
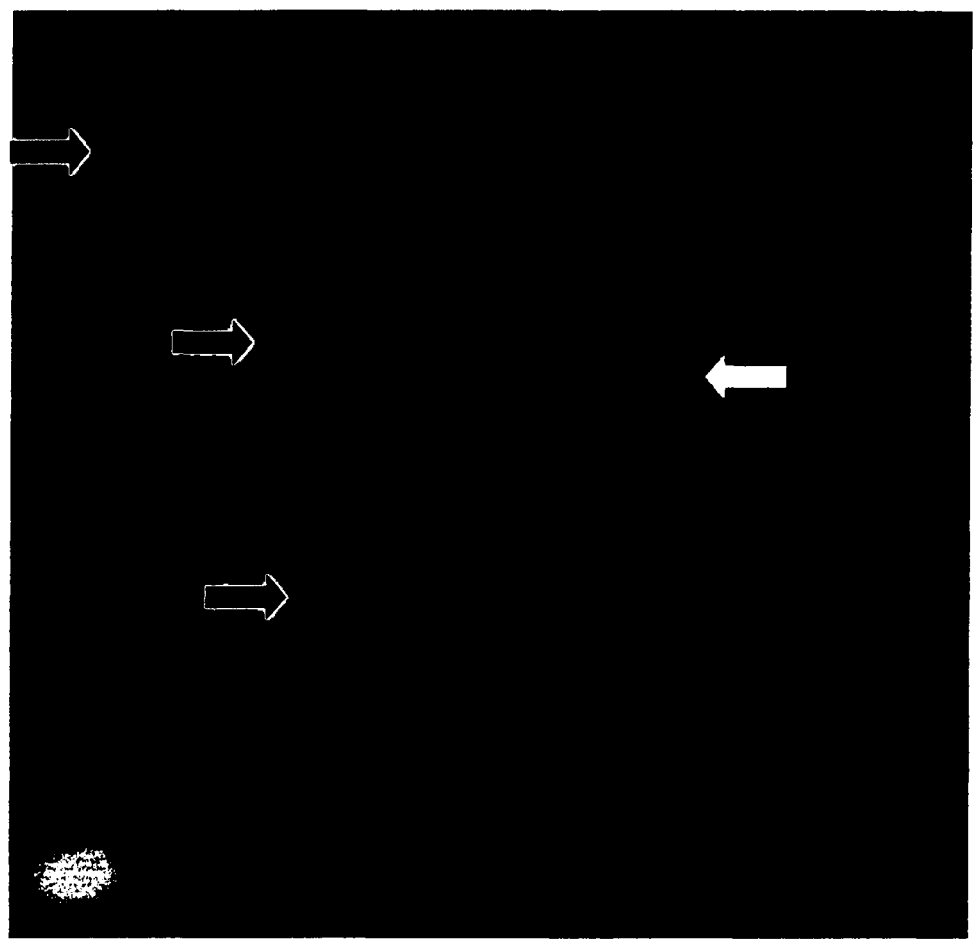

A transmission electron micrograph showing the CotE knockout spores is provided in FIG. 3. The closed arrows indicate fragments of exosporium that have been separated from the spores, and the open arrow indicates a spore from which the exosporium has been removed.

Figure 4:
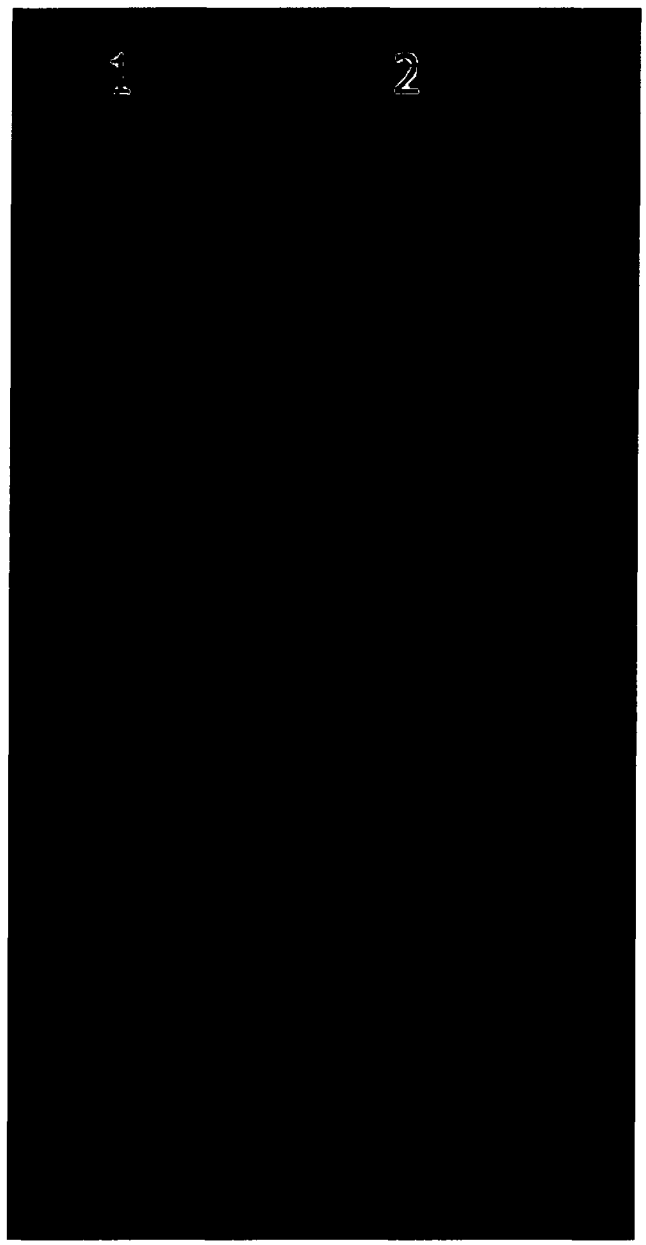

Purification of the exosporium fragments was performed as follows: CotE::kan spores were grown in brain heart infusion broth overnight at 30° C. and swabbed onto nutrient agar plates and grown at 30° C. for 3 days. After 3 days, the spores were collected by swabbing the plates with cotton swabs wetted with PBS and resuspended into 1 ml of PBS in a microcentrifuge tube. The spores were separated from the culture by centrifugation, and the supernatant containing the exosporium fragments was filtered through a 0.22 µM filter to remove any residual spores. The filtrate was then filtered through a 100 kDa filter to collect exosporium fragments but allow free proteins to pass through the filter. The 100 kDa filter was washed, and the collected exosporium fragments boiled in SDS buffer for 5 minutes and separated by SDS-PAGE electrophoresis. FIG. 4 provides a photograph of an SDS-PAGE gel showing the purified exosporium fragments (lane 2) and a protein marker standard (lane 1). The exosporium fragments shown in lane 2 represent the individual proteins that constitute the exosporium fragments. Only a subset of bands that would normally be seen in a whole spore SDS-PAGE preparation is apparent.

Figure 5:
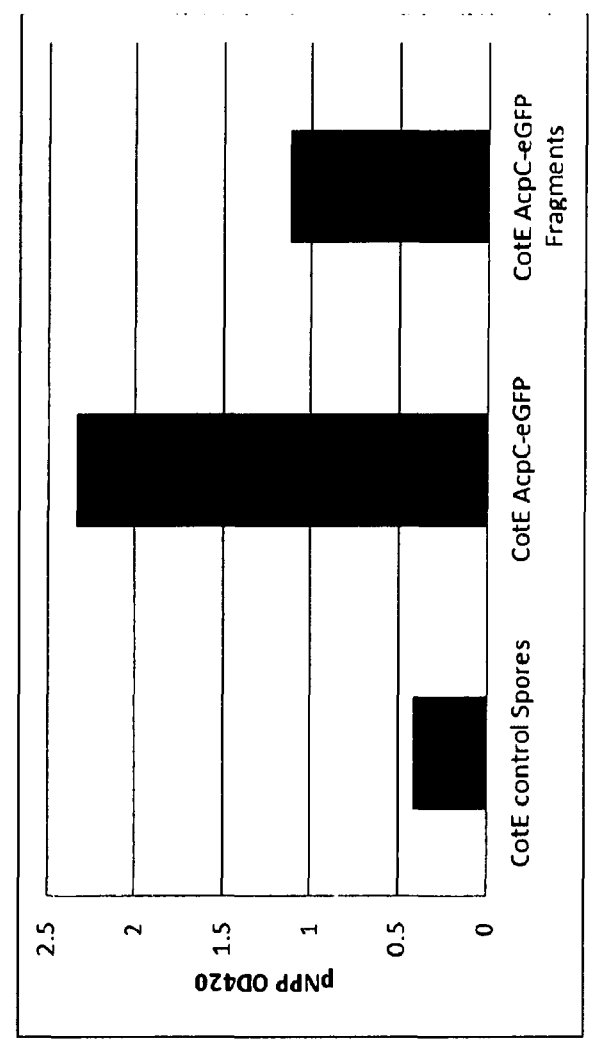

Ten microliters of the exosporium fragment preparation containing the AcpC-eGFP fusion protein was tested for activity in a phosphatase assay against pNPP (p-nitrophenyl polyphosphate). Acid phosphatase activity was detected by spectrophotometry based on release of p-nitrophenol from phosphate through phosphatase activity. Briefly, 1 ml of 10 mM pNPP in phosphate buffer at pH 6.0 was incubated with exosporium fragments in a 1 ml microcentrifuge tube and allowed to incubate at 37° C. for 10 minutes. After 10 minutes, the tube was centrifuged for 1 minute to remove excess spores, and the supernatant read on a spectrophotometer at 420 nm for free p-nitrophenol. It was found that the purified exosporium fragments were able to effectively release the phosphate groups from pNPP, demonstrating that the AcpC was present in the exosporium fragments. The results of this assay are shown in FIG. 5. In FIG. 5, "CotE control spores" refers to CotE knock-out spores alone (not expressing the AcpC-eGFP fusion protein), "CotE AcpC-eGFP" refers to the CotE knock-out spores expressing the AcpC-eGFP fusion protein, and "CotE AcpC-eGFP fragments" refers to the exosporium fragments obtained as described above from the CotE knock-out spores expressing the AcpC-eGFP fusion protein.

These results demonstrate that mutations that disrupt the exosporium, such as a knock-out mutation in the CotE gene, can be used to generate exosporium fragments that are substantially free of spores, and demonstrates that these exosporium fragments contain fusion proteins that are targeted to the exosporium.

Example 9: Generation of Recombinant *Bacillus cereus* Family Members Displaying Ovalbumin or the *Bacillus anthracis* Protective Antigen The *Gallus gallus* ovalbumin gene from GenScript ORF clone OGa28271C and the *Bacillus anthracis* protective antigen (pagA) gene were amplified via polymerase chain reaction (PCR) using the primers shown below in Table 31. The amino acid sequences encoded by the ovalbumin gene and pagA genes are provided in Table 32 below.

TABLE 31

| Primer sequences. | | |
|---|---|---|
| | OvaL | PagA |
| Forward | SEQ ID NO: 362 | SEQ ID NO: 364 |
| Reverse | SEQ ID NO: 363 | SEQ ID NO: 365 |

TABLE 32

| Ovalbumin and pagA sequences | |
|---|---|
| Protein | SEQ ID NO. |
| Ovalbumin, *Gallus gallus* | 366 |
| pagA, *Bacillus anthracis* | 367 |

The resulting PCR fragments were cloned into one of three expression plasmids (pSUPER-BclA-FL, pSUPER-BclA 20-35, or pSUPER-AcpC) using the splicing by overlapping extension (SOE) technique. The pSUPER-BclA-FL plasmid was generated through fusion of a PCR fragment which contained the BclA promoter (SEQ ID NO: 149), start codon, and coding sequence for full-length (FL) BclA fused in frame into the pSUPER plasmid. The pSUPER-BclA-20-35 plasmid was generated through fusion of a PCR fragment which contained the BclA promoter (SEQ ID NO: 149), start codon, and a coding sequence for amino acids 20-35 of BclA (amino acids 20-35 of SEQ ID NO: 1) fused in frame into the pSUPER plasmid. The pSUPER-AcpC plasmid was generated through fusion of a PCR fragment with included the native AcpC promoter (SEQ ID NO: 141), ribosomal binding site, and coding sequence for AcpC (from *B. thuringiensis* BT013A; SEQ ID NO: 120), fused in frame into the pSUPER plasmid. The pSUPER plasmid was generated through fusion of the pUC57 plasmid (containing an ampicillin resistance cassette) with the pBC16-1 plasmid from *Bacillus* (containing a tetracycline resistance). This 5.5 kbp plasmid can replicate in both *E. coli* and *Bacillus* spp.

The pSUPER-BclA-FL-OVAL construct generated using these methods encodes a fusion protein comprising full-length BclA and ovalbumin, and the pSUPER-BclA-FL-PAG encodes a fusion protein comprising full-length BclA and the *B. anthracis* protective antigen. These constructs were transformed into and propagated in *E. coli* strains. The sequences of the plasmids were verified by DNA sequencing.

In order to remove the *E. coli*-derived portions of the pSUPER plasmids and create smaller plasmids for expression in *Bacillus*, sequence-verified pSUPER constructs were amplified with primers that amplify the *Bacillus*-derived segment of the plasmid backbone. The resulting PCR products were self-ligated to generate the pBC plasmids (pBC-BclA-FL-OVAL plasmid and pBC-BclA-FL-PAG) that were used to transform various *Bacillus* strains in Example 10 below.

Example 10: Preparation and Purification of Exosporium Fragments

Knock Out (KO) Mutants: To make exsY and cotE knockout (KO) mutant strains of *Bacillus thuringiensis* BT013A, the plasmid pKOKI shuttle and integration vector was constructed that contained the pUC57 backbone, which is able to replicate in *E. coli*, as well as the origin of replication erythromycin resistance cassette from pE194. This construct is able to replicate in both *E. coli* and *Bacillus* spp. A 1 kb DNA region that corresponded to the upstream region of the cotE gene and a 1 kb region that corresponded to the downstream region of the gene cotE were PCR amplified from *Bacillus thuringiensis* BT013A. A second construct was made that contained the 1 kb DNA region that corresponded to the upstream region of the exsY gene and a 1 kb region that corresponded to the downstream region of the gene exsY, both of which were PCR amplified from *Bacillus thuringiensis* BT013A. For each construct, the two 1 kb regions were then spliced together using homologous recombination with overlapping regions with the pKOKI plasmid. The plasmid constructs were verified by digestion and DNA sequencing. Clones were screened by looking for erythromycin resistance.

Clones were passaged under high temperature (40° C.) in brain heart infusion (BHI) broth. Individual colonies were toothpicked onto LB agar plates containing erythromycin 5 µg/ml, grown at 30° C., and screened for the presence of the pKOKI plasmid as a free plasmid by colony PCR. Colonies that had an integration event were continued through passaging to screen for single colonies that lost erythromycin resistance (signifying loss of the plasmid but recombination and removal of the exsY or cotE gene). Verified deletions were confirmed by PCR amplification and sequencing of the target region of the chromosome. The pBC-BclA-FL-OVAL plasmid was transformed into the exsY knockout mutant and the pBC-BclA-FL-PAG plasmid was transformed into the cotE KO mutant. The pBC-BclA-FL-OVAL and pBC-BclA-FL-PAG plasmids are described above in Example 9.

Exosporium Fragment Creation: For each of the two KO mutants, overnight cultures were grown in BHI media at 30° C., 300 rpm, in baffled flasks with antibiotic selection. One milliliter of this overnight culture was inoculated into a yeast extract-based media (50 ml) in a baffled flask and grown at 30° C. for 3 days. An aliquot of spores was removed, 1% Tween was added, and the spores were agitated by vortexing for one minute. The spores were collected via centrifugation at 10,000×g for 5 minutes, and supernatant containing the exosporium fragments was filtered through a 0.22 µM filter to remove any residual spores. The supernatant (containing the exosporium fragments) was filtered through a 100,000 Da membrane filter to obtain purified exosporium fragments containing the fusion proteins. Smaller molecular weight proteins were removed by passaging through the 100 kDa filter. No spores were found in the filtrate or retentate of the supernatant.

Figure 6:
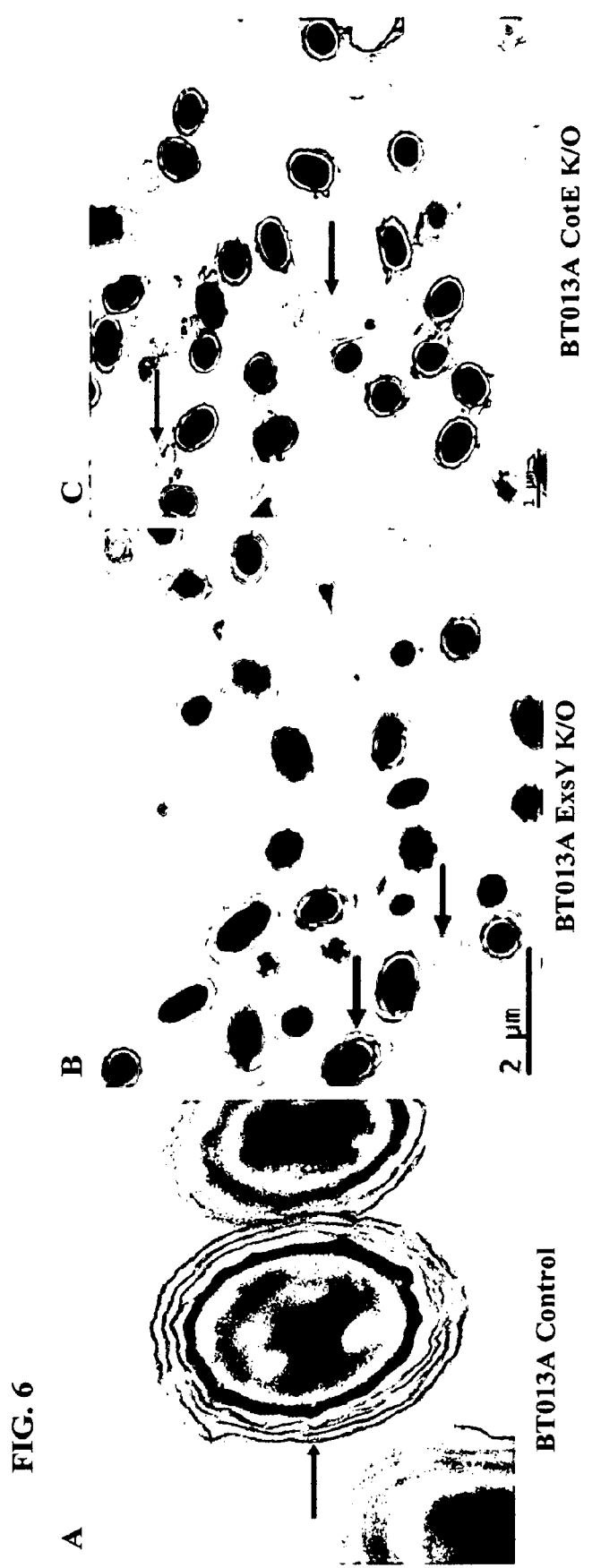

Transmission electron micrographs are provided in FIG. 6 showing intact spores of *Bacillus thuringiensis* BT013A (panel A) surrounded by attached exosporium, spores of the *Bacillus thuringiensis* BT013A ExsY knock-out mutant (panel B) from which the exosporium has detached, and spores of the *Bacillus thuringiensis* BT013A CotE knock-out mutant (panel C) from which the exosporium has detached. The arrow in panel A of FIG. 6 indicates the layers of exosporium of intact BT013A spores, while arrows in panels B and C of FIG. 6 indicate exosporium that has detached from the spores in both the CotE and ExsY mutants. Images were taken on a JEOL JEM 1400 transmission electron microscope. No visible exosporium fragments were observed when control spores expressing a fusion protein (*Bacillus thuringiensis* BT013A without the CotE knockout, expressing the BclA-FL-OVAL fusion protein, data not shown) were subjected to same centrifugation and filtration procedures described above.

Presence of BclA-FL-OVAL or BclA-FL-PAG Protective Antigen in Exosporium Fragments Collected from the CotE and ExsY Knockout Mutants: Exosporium fragments were created and purified as described above from spores that contained the pBC-BclA-FL-OVAL or pBC-BclA-FL-PAG plasmid. These spores create an exosporium that contains fusion proteins comprising full-length BclA and ovalbumin or protective antigen A. Exosporium fragments containing these constructs were created from the cotE knockout mutant spores and the exsY knockout mutant spores. The ovalbumin or protective antigen A protein concentration was determined by dot blot. Table 33 below summarizes the dot blot results as compared to purified protein. Briefly, an enriched exosporium fragment fraction generated as described above, whole cell broth, or purified ovalbumin or protective antigen was blotted onto nitrocellulose and then probed with commercially available rabbit polyclonal antibodies against full-length ovalbumin or *Bacillus anthracis* protective antigen. Whole cell broth was taken from the overnight cultures as described above and not subjected to any vortexing, filtration, or centrifugation steps. The blots were then developed with horseradish peroxidase (HRP)-conjugated secondary antibodies. The ovalbumin and protective antigen antibodies were verified by Western blot for size and specificity. Western blots were performed using purified ovalbumin and protective antigen proteins. The ovalbumin and protective antigen antibodies recognized bands of the correct size and did not cross-react with untransformed whole cell broth from *Bacillus thuringiensis* BT013A.

Dot blot results are shown below in Table 33. The results show that the protein of interest (OVAL or PAG) was present in both the whole cell broth and exosporium fragment-enriched fractions. Most of the protein of interest was retained in the exosporium fragment-enriched fractions, demonstrating that the proteins of interest were present on the exosporium fragments.

TABLE 33

PAG and OVAL expression detected by polyclonoal antibodies

| Host | Construct | Fraction Collected | Protein detected relative to the standard curve of the purified protein over background |
|---|---|---|---|
| exsY KO | BclA-FL-OVAL | Exosporium Fragment-Enriched | 1.66-fold increase |
| exsY KO | BclA-FL-OVAL | Whole Cell Broth | 1.85-fold increase |
| cotE KO | BclA-FL-PAG | Exosporium Fragment-Enriched | 1.12-fold increase |
| cotE KO | BclA-FL-PAG | Whole Cell Broth | 1.03-fold increase |

Example 11: Presence of BclA 20-35-Endoglucanase in Exosporium Fragments Collected from the CotE and ExsY Knockout and CotO Dominant Negative Mutants To provide a further demonstration that exosporium fragments containing fusion proteins can be generated using the CotE knockout and ExsY knockout strains, and to demonstrate that exosporium fragments can be generated using CotO dominant negative strains, PCR fragments were generated that contained the BclA promoter (SEQ ID NO: 149), start codon, and amino acids 20-35 of BclA fused in frame to *Bacillus subtilis* 168 endoglucanase (the signal peptide of SEQ ID NO: 334, directly linked to the β-1,4-endoglucanase of SEQ ID NO: 293). These PCR fragments were digested with XhoI and ligated into the SalI site of the pSUPER plasmid to generate the plasmid pSUPER-BclA 20-35-Endoglucanase.

The CotE and ExsY knockout mutants were generated as described above in Example 10.

Dominant Negative Mutants: To create dominant negative mutants, PCR amplification was performed on the N-terminal half and the C-terminal half of CotO (SEQ ID NO: 199), containing amino acids 1-81 and 81-199 respectively. These fragments were cloned into the pHP13 *E coli/Bacillus* shuttle vector using homologous recombination. Correct clones were verified by Sanger sequencing. Each of the two CotO dominant negative mutants was introduced into *Bacillus thuringiensis* BT013A.

Presence of BclA 20-35 Endoglucanase in Exosporium Fragments Collection from the CotE and ExsY Knockout and CotO Dominant Negative Mutants: Exosporium fragments were created and purified as described in Example 10 from spores that contained the pSUPER BclA 20-35-Endo plasmid. These spores create an exosporium that displays fusion proteins comprising full-length BclA linked to endoglucanase. Exosporium fragments containing this construct were created from the cotE knockout mutant spores, exsY knockout mutant spores, CotO N-terminal dominant negative mutant spores, or CotO C-terminal dominant negative mutant spores. In each of these experiments, the amount of activity for the endoglucanase on the exosporium fragments was quantified as a percentage of the total enzyme levels. These results were compared against results generated using wild-type *Bacillus thuringiensis* BT013A that did not contain any mutations, but did contain the pSUPER BclA 20-35-Endo plasmid. The results are shown in Table 34 below.

Effects of Exosporium Fragments on Plant Growth: These exosporium fragments were then delivered as a seed treatment onto soybean seeds (as described in Example 5 above). A wild-type control (*B. thuringiensis* BT013A expressing the BclA 20-35 Endo construct) was also coated onto soybeans seeds. For each experiment, 1 µl of exosporium fragments from each construct, or a 1:2, a 1:4, or a 1:8 dilution of the fragments was applied to each seed. Results are shown in Table 34 below.

soybean growth compared to the fragments from BT013A BclA 20-35 Endo, giving +6.5% and +2.7% increases in growth, respectively.

Example 12: Isolation and Identification of Plant-Growth Promoting Bacterial Strains Soil samples from rhizospheres of the healthiest and most resistant potato (*Solanum tuberosum*), yellow summer squash (*Cucurbita pepo*), tomato (*Solanum lycopersicum*), and pole bean (*Phaseolus coccineus*) plants were collected, diluted in sterile water, and spread onto nutrient agar plates.

TABLE 34

Exosporium Fragment Enzyme Activity and Plant Growth Response

| Mutation | Construct | Endoglucanase Activity, Exosporium Fragments (mU/ml) | Soy Plant Growth Response, 1:2 dilution | Soy Plant Growth Response, 1:4 dilution | Soy Plant Growth Response, 1:8 dilution | Presence of Spores? |
|---|---|---|---|---|---|---|
| Wild-type BT013A | BclA 20-35 Endo | 10.3 | 93.1% | 92.2% | 83.4% | No |
| cotE KO | BclA 20-35 Endo | 269.0 | 121.4% | 110.7% | 90.7% | No |
| exsY KO | BclA 20-35 Endo | 238.0 | 107.7% | 89.1% | 90.7% | No |
| CotO NTD dominant | BclA 20-35 Endo | 22.4 | 99.6% | N/A | N/A | No |
| CotO CTD dominant | BclA 20-35 Endo | 27.5 | 95.8% | N/A | N/A | No |

These results demonstrate that mutations that disrupt the exosporium, such as a knock-out mutation in the cotE or exsY gene, or a dominant negative mutation in the CotO protein, can be used to generate exosporium fragments that are substantially free of spores, and demonstrates that these exosporium fragments contain fusion proteins that are targeted to the exosporium. There was a small amount of background endoglucanase activity in the exosporium fragment preparation from the BT013 strain having no mutations and expressing the BclA 20-25 Endo construct (BT013A BclA 20-35 Endo). This was unexpected and may represent a low level of unstable exosporium that is being released from spores and captured during the exosporium fragment collection process. CotE and ExsY KO strains contained the highest amount of enzyme in the exosporium fragment fraction. The CotO dominant negative mutants that express a fusion protein also have an elevated level of enzyme in the exosporium fragment fraction.

The exosporium fragments from the CotE and ExsY mutants (not expressing BclA 20-35 Endo) applied directly to plants had a negative effect on growth and were removed from this experiment. When the exosporium fragments from BT013A BclA 20-35 Endo were applied to soybeans, there was a negative growth phenotype. When exosporium fragments from the CotE or ExsY mutants expressing the BclA 20-35 Endo fusion protein were added to soybeans, a substantial increase in growth rate occurred (+28.3% and +14.8% over BT013A BclA 20-35 Endo fragments). The CotE mutant exosporium fragments were still active at the 1:4 dilution, but the ExsY exosporium fragments were no longer giving a growth benefit to the soybeans at this dilution. The CotO dominant negative mutants expressing the BclA 20-35 Endo fusion protein gave a small increase in Bacterial isolates that demonstrated high growth rates and were able to be passaged and propagated were selected for further study. The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and resuspended in an equal amount of distilled water. Ten butterhead lettuce seeds per treatment were planted at a depth of 1 cm in loam top soil (Columbia, MO) that was sieved to remove large debris. Seeds were inoculated at planting in 4 cm pots with 0.5 µl of resuspended bacteria in water mixed into 10 ml of $H_2O$. Ten ml of $H_2O$ was sufficient to deliver the bacteria into the 3 $in^3$ (49.16 $cm^3$) of soil as well as saturate the soil for proper germination of seeds. Plants were grown at temperatures between 65-75° F. (18-24° C.) with 11 hours of light/day, and 5 ml of watering every 3 days. After one week, plant heights and leaf diameters, as well as overall health of the plants were collected. Initial screening of rhizosphere isolates resulted in obtaining greater than 200 distinct species of bacteria and fungi from the rhizosphere of the four plants. Some of the bacterial species are described in Table 35 below. Identified strains are indicated by their proper bacterial identifications. Other strains are indicated by their unknown identification number. Inoculants giving results near control (+/−2%) were not included in the table.

TABLE 35

| Bacterial Inoculant | Avg. Height (cm) | Comparison | SEM |
|---|---|---|---|
| Uninoculated | 1.8 | Control | .07 |
| *Paracoccus kondratiavae* NC35 | 2 | 111.1% | .05 |
| *B. aryabhattai* CAP53 | 3.65 | 202.8% | .45 |

TABLE 35-continued

| Bacterial Inoculant | Avg. Height (cm) | Comparison | SEM |
|---|---|---|---|
| B. flexus BT054 | 2.45 | 136.1% | .11 |
| Bacillus mycoides strain BT155 | 2.17 | 120.4% | .21 |
| B. aryabhattai CAP56 | 2.1 | 116.7% | .20 |
| B. nealsonii BOBA57 | 2.8 | 155.6% | .03 |
| E. cloacae CAP12 | 2.4 | 133.3% | .41 |
| Unknown 8 | 1.77 | 77.8% | .65 |
| Unknown 122 | 1.9 | 105.6% | .11 |
| Unknown 15 | 1.4 | 77.8% | .41 |
| Unknown 39 | 1.8 | 100.0% | .20 |
| Unknown 401 | 2 | 111.1% | .21 |
| Unknown 402 | 1.53 | 85.2% | .27 |
| Unknown 41 | 1.45 | 80.6% | .31 |
| Unknown 42 | 1.4 | 77.8% | .15 |
| Unknown 44 | 2.2 | 133.3% | .08 |
| Unknown 51 | 1.83 | 102.9% | .21 |

Bacterial strains that produced the greatest effect on the overall plant health and plant height in the initial lettuce trial were subjected to further identification. Bacterial strains were grown overnight in Luria Bertani broth at 37° C., and overnight cultures were spun down in a centrifuge. Media was decanted and the remaining bacterial pellet was subjected to chromosomal DNA isolation using the Qiagen Bacterial Chromosomal DNA Isolation kit. Chromosomal DNA was subjected to PCR amplification of the 16S rRNA coding regions using the primers E338F 5'-ACT CCT ACG GGA GGC AGC AGT-3' (SEQ ID NO: 368), E1099R A 5'-GGG TTG CGC TCG TTG C-3' (SEQ ID NO: 369), and E1099R B 5'-GGG TTG CGC TCG TTA C-3' (SEQ ID NO: 370). PCR amplicons were purified using a Promega PCR purification kit, and the resultant amplicons were diluted and sent to the University of Missouri DNA Core for DNA sequencing. DNA sequences were compared to the NCBI BLAST database of bacterial isolates, and genus and species were identified by direct comparison to known strains. Top identified species are indicated in Table 35 above. In many cases, 16S rRNA DNA sequences were only able to delineate the genus of the selected bacterial strain. In cases where a direct identification was not forthcoming, additional biochemistry analyses, using methods standard in the field, were performed to differentiate strains at the species and strain levels, and are listed in Table 36 below.

Example 13: Isolation and Identification of Additional Plant-Growth Promoting Bacterial Strains Soil samples from agricultural fields near Gas, Kansas were collected, diluted in sterile water, and spread onto nutrient agar plates. Bacterial isolates that demonstrated high growth rates and were able to be passaged and propagated were selected for further study. The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and resuspended in an equal amount of distilled water. Corn seeds were coated with commercial seed polymer mixed with water alone (1.6 µl per seed total) or commercial seed polymer containing selected bacterial strains (1.6 µl per seed total). Coated seeds were planted in 3 inch (7.62 cm) diameter pots at a depth of 1 inch (2.54 cm) in loam top soil (Columbia, MO) that was sieved to remove large debris. Plants were grown at temperatures between 18-24° C. (65-75° F.) with 11 hours of light/day, and 50 ml of watering at planting and every 3 days. After two weeks, plant heights and leaf diameters, as well as overall health of the plants were collected. For germination assays and determining 3 day root length, seeds were coated as indicated above and evenly dispersed at 10 seeds per paper towel. The paper towels were wetted with 10 ml of water, rolled up, placed in a small plastic bag and incubated at 30° C. or placed on a germination heat mat at 27-30° C. (80-85° F.). Root measurements were recorded after 3 days. Initial screening of rhizosphere isolates resulted in obtaining greater than 100 distinct species of bacteria and fungi from the rhizosphere. Some of the bacterial species are described in Table 37 below. Identified strains are indicated by their proper bacterial identifications.

TABLE 37

| Bacterial Inoculant | Avg. Height (2 weeks), normalized to polymer control (%) | Avg. Root Length (3 days), normalized to polymer control (%) |
|---|---|---|
| Polymer control | 100 | 100 |
| B. mycoides EE118 | 111.1 | 189.1 |
| B. subtilis EE148 | 99.4 | 172.8 |
| Alcaligenes faecalis EE107 | 111.5 | 129.2 |
| B. mycoides EE141 | 109.2 | 143.5 |
| B. mycoides BT46-3 | 105.6 | 141.3 |

TABLE 36

| Test | E. cloacae CAP 12 | P. kondratiavae NC35 | B. aryabhattai CAP53 | B. flexus BT054 | B. mycoides BT155 | B. aryabhattai CAP56 | B. nealsonii BOBA57 |
|---|---|---|---|---|---|---|---|
| Urease | − | − | − | − | − | − | + |
| Catalase | + | + | + | + | + | + | + |
| Oxidase | − | + | + | + | − | − | − |
| Nitrate | + | + | − | + | + | − | + |
| Growth, 5% NaCl | + | − | + | + | − | + | + |
| Growth, 7.5% NaCl | − | − | + | + | − | + | − |
| Growth, 42° C. | + | + | + | + | + | + | + |
| Growth, 50° C. | − | − | + | + | − | + | − |
| Growth, pH 5 | + | − | + | + | + | + | − |
| Growth, pH 9 | + | + | + | + | + | + | + |
| Acid, Cellobiose | + | − | + | + | + | + | − |
| Acid, Lactose | + | − | + | + | + | − | + |
| Acid, Starch | − | − | − | + | − | + | − |

TABLE 37-continued

| Bacterial Inoculant | Avg. Height (2 weeks), normalized to polymer control (%) | Avg. Root Length (3 days), normalized to polymer control (%) |
|---|---|---|
| B. cereus family member EE128 | 105.6 | — |
| B. thuringiensis BT013A | 101.8 | 103.8 |

BLAST database of bacterial isolates, and genus and species were identified by direct comparison to known strains. Top identified species are indicated in Table 37 above. In many cases, 16S rRNA DNA sequences were only able to delineate the genus of the selected bacterial strain. In cases where a direct identification was not forthcoming, additional biochemistry analyses, using methods standard in the field, were performed to differentiate strains at the species and strain levels, and the differentiated strains are listed in Table 38 below.

TABLE 38

| Test | B. thuringiensis BT013A | B. cereus family member EE349 | B. subtilis EE148 | B. subtilis EE218 | B. megaterium EE281 | Paenibacillus massiliensis BT23 | B. mycoides BT46-3 | Alcaligenes faecalis EE107 | B. mycoides EE118 | B. cereus family member EE128 | B. mycoides EE141 |
|---|---|---|---|---|---|---|---|---|---|---|---|
| Motility | + | + | + | + | + | + | − | + | − | − | − |
| Rhizoid Colony | − | − | − | − | − | + | + | − | + | − | + |
| Catalase | + | + | + | + | + | + | + | + | + | + | + |
| Oxidase | + | − | − | − | − | − | − | + | − | − | − |
| Nitrate | + | + | wk | − | − | − | + | + | + | + | + |
| Growth, 5% NaCl | + | wk | − | + | + | − | + | + | − | + | − |
| Growth, 7.5% NaCl | wk | − | − | + | + | − | − | − | − | − | − |
| Growth, 42° C. | − | + | + | + | + | + | + | + | − | + | − |
| Growth, 50° C. | − | − | − | − | − | − | − | − | − | − | − |
| Growth, pH 5 | wk | − | + | + | + | − | wk | + | − | + | − |
| Growth, pH 9 | + | + | − | + | + | − | wk | + | + | + | − |
| Acid, Cellobiose | − | − | wk | + | − | + | + | wk | + | − | wk |
| Acid, Lactose | − | + | + | + | + | − | + | + | − | + | wk |
| Acid, Starch | − | + | − | + | + | − | + | wk | + | + | − | wk = weak growth or low growth

TABLE 37-continued

| Bacterial Inoculant | Avg. Height (2 weeks), normalized to polymer control (%) | Avg. Root Length (3 days), normalized to polymer control (%) |
|---|---|---|
| Paenibacillus massiliensis BT23 | 104.2 | 139.4 |
| B. cereus family member EE349 | 105.2 | — |
| B. subtilis EE218 | 106.6 | — |
| B. megaterium EE281 | 107.8 | — |

Bacterial strains that produced the greatest effect on plant health are described in Table 37 above. Bacterial strains were grown overnight in Luria Bertani broth at 37° C., and overnight cultures were spun down in a centrifuge. Media was decanted and the remaining bacterial pellet was subjected to chromosomal DNA isolation using the Qiagen Bacterial Chromosomal DNA Isolation kit. Chromosomal DNA was subjected to PCR amplification of the 16S rRNA coding regions using the primers E338F 5'-ACT CCT ACG GGA GGC AGC AGT-3' (SEQ ID NO: 368), E1099R A 5'-GGG TTG CGC TCG TTG C-3' (SEQ ID NO: 369), and E1099R B 5'-GGG TTG CGC TCG TTA C-3' (SEQ ID NO: 370). PCR amplicons were purified using a Promega PCR purification kit, and the resultant amplicons were diluted and sent to the University of Missouri DNA Core for DNA sequencing. DNA sequences were compared to the NCBI Example 14: Testing of Plant-Growth Promoting Bacterial Strains on Alfalfa The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and bacteria resuspended in an equal amount of distilled water. Ten ZEBA-coated alfalfa seeds were planted for each treatment at a depth of 0.6 cm in loam top soil (Columbia, MO) that was sieved to remove large debris. ZEBA is a superabsorbent cornstarch based polymer used as a moisture-retention seed coating. Seeds were inoculated at planting with 0.5 μl of resuspended bacteria in water mixed into 10 ml of $H_2O$. Ten ml of $H_2O$ was sufficient to deliver the bacteria into the 3 in$^3$ (49.16 cm$^3$) of soil as well as saturate the soil for proper germination of seeds. Plants were grown at temperatures between 65-75° F. (18-24° C.) with 11 hours of light/day, and 5 ml of watering every 3 days. Alfalfa was allowed to grow for 1 week to analyze emergence and initial outgrowth of plants under described conditions. Identified strains indicated by their proper bacterial identifications and final height data are listed in Table 39 below.

TABLE 39

| Bacterial Inoculant | Avg. Height (cm) | Comparison | SEM |
|---|---|---|---|
| Uninoculated | 4.82 | — | .008 |
| B. aryabhattai CAP56 | 4.85 | 101.20% | .016 |
| B. nealsonii BOBA57 | 4.86 | 101.70% | .021 |
| E. cloacae CAP12 | 5.6 | 116.23% | .020 |

Example 15: Testing of Plant-Growth Promoting Bacterial Strains on Cucumbers

The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and resuspended in equal amount of distilled water. Ten cucumber seeds were planted for each treatment at a depth of 1 cm in loam top soil (Columbia, MO) that was sieved to remove large debris. Seeds were inoculated at planting with 0.5 µl of resuspended bacteria in water mixed into 10 ml of $H_2O$. Ten ml of $H_2O$ was sufficient to deliver the bacteria into the 3 in$^3$ (49.16 cm$^3$) of soil as well as saturate the soil for proper germination of seeds. Plants were grown at temperatures between 65-75° F. (18-24° C.) with 11 hours of light/day, and 5 ml of watering every 3 days. Cucumbers were allowed to grow for 2 weeks to analyze emergence and initial outgrowth of plants under described conditions. Identified strains indicated by their proper bacterial identifications and final height data are listed in Table 40 below.

TABLE 40

| Bacterial Inoculant | Avg. Height (cm) | Comparison | SEM |
|---|---|---|---|
| Uninoculated | 11.23 | — | .067 |
| B. aryabhattai CAP53 | 11.5 | 102.00% | .023 |
| B. aryabhattai CAP56 | 11.35 | 101.20% | .035 |
| B. nealsonii BOBA57 | 11.33 | 101.10% | .014 |

Example 16: Testing of Plant-Growth Promoting Bacterial Strains on Yellow Squash The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and resuspended in an equal amount of distilled water. Ten yellow squash seeds were planted for each treatment at a depth of 1 cm in loam top soil (Columbia, MO) that was sieved to remove large debris. Seeds were inoculated at planting with 0.5 µl of resuspended bacteria in water mixed into 10 ml of $H_2O$. Ten ml of $H_2O$ was sufficient to deliver the bacteria into the 3 in$^3$ (49.16 cm$^3$) of soil as well as saturate the soil for proper germination of seeds. Plants were grown at temperatures between 65-75° F. (18-24° C.) with 11 hours of light/day, and 5 ml of watering every 3 days. Squash was allowed to grow for 2 weeks to analyze emergence and initial outgrowth of plants under described conditions. Identified strains indicated by their proper bacterial identifications, final height data, and final leaf diameter (by span of the two leaves) data are listed in Table 41 below.

TABLE 41

| Bacterial Inoculant | Avg. Height (cm) | Comparison | SEM | Leaf Diameter (cm) | Comparison |
|---|---|---|---|---|---|
| Uninoculated | 10.16 | — | .028 | 5.08 | — |
| B. aryabhattai CAP53 | 11.75 | 115.60% | .055 | 7.25 | 142.60% |
| B. flexus BT054 | 11.88 | 116.90% | .017 | 6.36 | 125.20% |
| Bacillus mycoides BT155 | 11.92 | 117.20% | .051 | 6.33 | 124.60% |
| B. aryabhattai CAP56 | 11.95 | 117.60% | .027 | 6.33 | 124.60% |
| B. nealsonii BOBA57 | 11.89 | 117.00% | .118 | 6.42 | 126.40% |
| E. cloacae CAP12 | 11.42 | 112.30% | .039 | 6.83 | 134.40% |

Example 17: Testing of Plant-Growth Promoting Bacterial Strains on Ryegrass

The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and resuspended in an equal amount of distilled water. Thirty ryegrass seeds were planted for each treatment at a depth of 0.3 cm in loam top soil (Columbia, MO) that was sieved to remove large debris. Seeds were inoculated at planting with 0.5 µl of resuspended bacteria in water mixed into 10 ml of $H_2O$. Ten ml of $H_2O$ was sufficient to deliver the bacteria into the 3 in$^3$ (49.16 cm$^3$) of soil as well as saturate the soil for proper germination of seeds. Plants were grown at temperatures between 65-75° F. (18-24° C.) with 11 hours of light/day, and 5 ml of watering every 3 days. Ryegrass was allowed to grow for 1.5 weeks to analyze emergence and initial outgrowth of plants under described conditions. Identified strains indicated by their proper bacterial identifications and height data are listed in Table 42 below.

TABLE 42

| Bacterial Inoculant | Avg. Height (cm) | Comparison | SEM |
|---|---|---|---|
| Uninoculated | 1.61 | — | .023 |
| B. aryabhattai CAP53 | 2.01 | 124.70% | .012 |
| B. flexus BT054 | 2.21 | 137.30% | .034 |
| Bacillus mycoides BT155 | 2.29 | 142.20% | .049 |
| B. aryabhattai CAP56 | 2.19 | 136.00% | .009 |
| B. nealsonii BOBA57 | 2.29 | 142.40% | .045 |
| E. cloacae CAP12 | 1.98 | 122.50% | .015 |

Example 18: Testing of Plant-Growth Promoting Bacterial Strains on Corn

The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight). Overnight cultures (30° C.) of selected strains were spun down, media decanted off, and resuspended in an equal amount of distilled water. Ten corn seeds were planted for each treatment at a depth of 2.5 cm in loam top soil (Columbia, MO) that was sieved to remove large debris. Seeds were inoculated at planting with 0.5 µl of resuspended bacteria in water mixed into 10 ml of $H_2O$. Ten ml of $H_2O$ was sufficient to deliver the bacteria into the 3 in$^3$ (49.16 cm$^3$) of soil as well as saturate the soil for proper germination of seeds. Plants were grown at temperatures between 65-75° F. (18-24° C.) with 11 hours of light/day, and 5 ml of watering every 3 days. Corn was allowed to grow for 2 weeks to analyze emergence and initial outgrowth of plants under described conditions. Identified strains indicated by their proper bacterial identifications and final height data are listed in Table 43 below.

TABLE 43

| Bacterial Inoculant | Avg. Height (cm) | Comparison | SEM |
|---|---|---|---|
| Uninoculated | 8.9 | — | .039 |
| B. aryabhattai CAP53 | 11.01 | 123.60% | .081 |
| B. flexus BT054 | 9.96 | 112.00% | .095 |
| Bacillus mycoides strain BT155 | 9.6 | 107.90% | .041 |
| B. aryabhattai CAP56 | 9.54 | 107.10% | .088 |
| B. nealsonii BOBA57 | 9.23 | 103.70% | .077 |

Example 19: Testing of Plant-Growth Promoting Bacterial Strains on Soybeans

The selected strains were grown in minimal media ($KH_2PO_4$ 3 g, $Na_2HPO_4$ 6 g, $NH_4Cl$ 1 g, NaCl 0.50 g, $MgSO_4$ $7H_2O$ 0.15 g, $CaCl_2$ $2H_2O$ 0.013 g, and glucose 1 g, per L dry weight, or for *Bradyrhizobium* or *Rhizobium* on yeast mannitol media). Overnight cultures (30° C.) of selected strains were spun down, media decanted off, and resuspended in equal amount of distilled water. Ten soybean seeds were planted for each treatment at a depth of 2.5 cm in loam top soil (Columbia, MO) that was sieved to remove large debris. Seeds were inoculated at planting with 0.5 µl of resuspended bacteria in water mixed into 10 ml of $H_2O$. When testing two bacterial strains, 0.5 µl of each resuspended bacteria was mixed into 10 ml of $H_2O$. Ten ml of $H_2O$ was sufficient to deliver the bacteria into the 3 $in^3$ (49.16 $cm^3$) of soil as well as saturate the soil for proper germination of seeds. Plants were grown at temperatures between 65-75° F. (18-24° C.) with 11 hours of light/day, and 5 ml of watering every 3 days. Soybeans were allowed to grow for 2 weeks to analyze emergence and initial outgrowth of plants under described conditions. Identified strains indicated by their proper bacterial identifications and final height data are listed in Table 44 below. Co-inoculation of bacteria strains in the present invention with members of the *Bradyrhizobium* sp. or *Rhizobium* sp. lead to an increase in plant growth compared to either inoculant alone.

TABLE 44

| Bacterial Inoculant | Avg. Height (cm) | Comparison | SEM |
|---|---|---|---|
| Uninoculated | 13.94 | — | .089 |
| B. aryabhattai CAP53 | 16.32 | 117.1% | .146 |
| B. flexus BT054 | 17.85 | 128.0% | .177 |
| Bacillus mycoides strain BT155 | 18.93 | 135.8% | .117 |
| B. aryabhattai CAP56 | 17.23 | 123.6% | .133 |
| B. aryabhattai CAP53 | 16.32 | 117.1% | .077 |
| B. aryabhattai CAP53 and Bradyrhizobium sp. | 16.72 | 119.9% | .182 |
| B. aryabhattai CAP53 and Rhizobium sp. | 17.32 | 124.2% | .086 |
| Bradyrhizobium sp. | 14.25 | 102.2% | |
| Rhizobium sp. | 14.75 | 105.8% | |

Example 20: *Bacillus cereus* Family Members with Plant Growth Promoting Attributes

*Bacillus mycoides* strain BT155, *Bacillus mycoides* strain EE118, *Bacillus mycoides* strain EE141, *Bacillus mycoides* strain BT46-3, *Bacillus cereus* family member strain EE349, *Bacillus thuringiensis* strain BT013A, and *Bacillus megaterium* strain EE281 were grown in Luria Bertani broth at 37° C. and overnight cultures were spun down, media decanted off, and resuspended in equal amount of distilled water. Twenty corn seeds were planted for each treatment at a depth of 2.5 cm in loam top soil (Columbia, MO) that was sieved to remove large debris. Seeds were inoculated at planting with 0.5 µl of resuspended bacteria in water mixed into 50 ml of $H_2O$. Fifty ml of $H_2O$ was sufficient to deliver the bacteria into the 29 $in^3$ (475.22 $cm^3$) of soil as well as saturate the soil for proper germination of seeds. Plants were grown at temperatures between 65-72° F. with 13 hours of light/day, and 5 ml of watering every 3 days. Seedlings were allowed to grow for 2 weeks to analyze emergence and initial outgrowth of plants under described conditions. Identified strains indicated by their proper bacterial identifications and final height data are listed in Table 45 below.

TABLE 45

| Bacterial Inoculant | Avg. Height, cm, Corn | Percentage | SEM |
|---|---|---|---|
| $H_2O$ Control | 11.41 | 100% | .123 |
| *B. mycoides* EE118 | 12.43 | 108.9% | .207 |
| *B. mycoides* EE141 | 12.84 | 112.5% | .231 |
| *B. mycoides* BT46-3 | 11.81 | 103.5% | .089 |
| *Bacillus thuringiensis* BT013A | 12.05 | 105.6% | .148 |
| *Bacillus cereus* family member EE128 | 13.12 | 114.9% | .159 |
| *Bacillus mycoides* BT155 | 12.85 | 112.6% | .163 |
| *Bacillus megaterium* EE281 | 11.99 | 105.1% | .098 |

All plant-growth promoting bacteria tested had a beneficial effect on corn height at two weeks under the described conditions. The *Bacillus cereus* family member EE128 strain had the greatest effect in this trial, giving a greater than at 14% boost in corn height.

Example 21: Enhanced Selection of *Bacillus cereus* Family Members to Screen for Plant Growth-Promoting and Other Beneficial Activities as BEMD Expression Host The BEMD system can be used to display a wide range of proteins, peptides, and enzymes using any of the targeting sequences described herein to provide beneficial agricultural effects. Additional beneficial effects can be obtained by selecting an expression host (a *Bacillus cereus* family member) having inherent beneficial attributes. Many strains of members of the *Bacillus cereus* family have plant-growth promoting benefits. Additionally, many *Bacillus cereus* family member strains provide have protective effects, through direct fungicidal, insecticidal, nematocidal, or other protective activities. By using such strains these as the expression host for the BEMD system, the end spore product would have a combination of positive benefits in agriculture.

Table 46 below provides results for an experiment wherein a fusion protein was expressed in various *Bacillus cereus* family member strains. All strains expressed a fusion protein comprising amino acids 1-35 of SEQ ID NO: 1 and the phosphatase PhoA4 from *Bacillus subtilis*, a beneficial enzyme for enhanced phosphate uptake in corn. The gene was synthesized, cloned into the pMK4 vector, and introduced into each of the *Bacillus* spp. indicated in Table 46 below. Strains were taken into sporulation by incubation at 30° C. on nutrient agar plates containing chloramphenicol 10 µg/ml for three days. Spores were collected, washed, and applied to corn at planting at a rate of $1\times10^5$ CFU/ml in 50 ml of water per 7.62 cm diameter pot with 5 mg polyphosphate per pot. Corn was grown in silt loam soil for two weeks. Plants were grown under ideal light using T5 lamps, 54 watts, and exposed to 13 hours of light a day under controlled temperature conditions between 15.5-25.5° C. Plants were watered to saturation every three days over a two week trial. At the end of two weeks, the height of each plant was measured and measurements were normalized to control *Bacillus thuringiensis* spores. Expression of the amino acids 1-35 of SEQ ID NO: 1—Phosphatase fusion protein led to an increase in corn height at 2 weeks regardless of the expression host strain selected. As shown in Table 46, use of a plant-growth promoting *Bacillus cereus* family member further increased corn height

TABLE 46

| *Bacillus* Species | Strain | Fusion Protein | Height at 2 weeks, Normalized |
| --- | --- | --- | --- |
| B. thuringiensis | Strain BT013A | None | 100% |
| B. thuringiensis | Strain BT013A | SEQ ID NO: 1-Phosphatase | 117.4% |
| B. mycoides | Strain EE141 | None | 107.3% |
| B. mycoides | Strain EE141 | SEQ ID NO: 1-Phosphatase | 123.3% |
| B. cereus family member | Strain EE128 | None | 124.1% |
| B. cereus family member | Strain EE128 | SEQ ID NO: 1-Phosphatase | 131.7% |
| B. mycoides | Strain BT155 | None | 104.8% |
| B. mycoides | Strain BT155 | SEQ ID NO: 1-Phosphatase | 121.9% |

Example 22: Expression of Fusion Proteins in an Endophytic *Bacillus cereus* Family Strain

*Bacillus cereus* family member EE349 was found to have the ability to grow endophytically and to be capable as serving as a host strain for the BEMD system. To demonstrate the ability of *Bacillus cereus* family member EE349 to grow endophytically and to serve as a host strain for the BEMD system, *Bacillus cereus* family member EE349 was transformed with the pSUPER-BclA 20-35-endoglucanase plasmid (described above in Example 4). The transformed bacteria were then induced to sporulate by swabbing the bacteria onto nutrient agar plates and incubating the plates at 30° C. for 72 hours. After 72 hours, the bacterial spores were collected from the plate by swabbing into sterile phosphate buffered saline (PBS), and were purified by density centrifugation three times.

These spores were diluted to a concentration of $1 \times 10^5$ spores/50 ml water, and the 50 ml of water was then added to commercial hybrid corn seed in potting soil at planting. The corn seeds were coated with a fungicide and a biological inoculant. The corn hybrid variety was BECK 5475RR, which contains the ROUNDUP READY glyphosate resistance gene and AQUAMAX drought resistance gene. Plants were grown under artificial light for 14 hours a day and plant growth over a ten day period was determined. Plants were watered every three days over the course of the experiment. After ten days, the plants were measured for height and normalized against the height of untreated corn plants. The results of these experiments are shown in Table 47 below.

TABLE 47

Effects of an endophytic *Bacillus cereus* family member expressing the BclA 20-35-endoglucanase fusion protein on corn seedling growth

| Plasmid | Expression Strain | Corn Growth (Normalized) |
| --- | --- | --- |
| None (Control) | None | 100% |
| None | *Bacillus cereus* family member EE349 | 104.1% |
| pSUPER-BclA 20-35-endoglucanase | *Bacillus cereus* family member EE349 | 111.5% |

As can be seen from the data shown in Table 47, expression of the pSUPER-BclA 20-35-endoglucanase in the endophytic strain *Bacillus cereus* family member EE349 resulted in increased corn growth as compared to untreated plants, or plants treated with *Bacillus cereus* family member EE349 alone.

*Bacillus cereus* family member EE349 expressing the BclA 20-35-endoglucanase was then isolated from the inside of the corn plants. The ten day old plants were extracted from the soil and washed to remove excess debris. The plants were then inverted, exposed to 5% bleach for ten minutes, washed in water, exposed to hydrogen peroxide (10%) for ten minutes, washed again in water, and the stalks split with a sterile razor blade. The split halves of the stalks were placed face down onto nutrient agar plates for two hours. After two hours, the stalks were removed, and the agar plates incubated at 30° C. for 48 hours. After 48 hours, the plates were examined for colony morphology, and *Bacillus cereus* family member colonies found internal to the plant were toothpicked onto nutrient agar and nutrient agar plus tetracycline plates (to select for bacteria containing the pSUPER-20-35 BclA-endoglucanase plasmid). The resultant increase in *Bacillus cereus* family member EE349 colony numbers is indicated shown in Table 48 below. These results demonstrate the ability of the BEMD system to be introduced into the target plant by expression in an endophytic strain of the *Bacillus cereus* family.

TABLE 48

Endophytic assay on *Bacillus cereus* family member EE349

| Treatment | Endophytic Bacteria (Total) | *Bacillus cereus* family bacteria (all strains) | Tetracycline resistant *Bacillus cereus* family members |
| --- | --- | --- | --- |
| H₂O (Control) | 156 | 31 | 0 |
| *Bacillus cereus* family member EE349 transformed with pSUPER-20-35 BclA-endoglucanase | 221 | 64 | 21 |

Tetracycline resistant *Bacillus* clones were grown overnight at 30° C. in brain heart infusion broth plus tetracycline, and spun down at 10,000×g for 5 minutes. The supernatant was removed, and the pellet frozen overnight at −20° C. Chromosomal DNA was then extracted from each clone, and the presence of the pSUPER-20-35 BclA-endoglucanase plasmid determined by transformation of the chromosomal DNA (containing the plasmid) into DH5α *E. coli* cells and plating on LB plus ampicillin plates. Correct clones were subjected to DNA sequence analysis, which verified that Bacillus cereus family member EE349 was internal to the plant (endophytic) and contained the plasmid.

Many endophytic bacteria were found in the corn seedlings, with a number of different strains and species within the Bacillus cereus family found inside both the control and the EE349 treated plants. The tetracycline resistant Bacillus cereus family members (indicating the presence of the pSUPER-20-35 BclA-endoglucanase plasmid) were only found in the treated corn seedlings, and all had the same colony morphology of the original expression host, Bacillus cereus family members EE349. The presence of the pSUPER 20-35 BclA-endoglucanase plasmid was verified by PCR amplification using unique primers.

Example 23: Isolation, Identification, and Characterization of Endophytic Bacillus cereus Family Bacterial Strains In addition to the endophytic strain Bacillus cereus family member EE349 discussed above in the immediately preceding example, several other Bacillus cereus family members that have the ability to grow endophytically were also identified: Bacillus cereus family member EE439, Bacillus thuringiensis EE417, Bacillus cereus EE444, Bacillus thuringiensis EE319, Bacillus thuringiensis EE-B 00184, Bacillus mycoides EE-B 00363, Bacillus pseudomycoides EE-B00366, and Bacillus cereus family member EE-B00377.

To obtain these additional Bacillus cereus family members, commercial hybrid corn seed was planted in potting soil and allowed to grow. The corn seeds were coated with a fungicide and a biological inoculant. Plants were grown under artificial light for 14 hours a day and plant growth over a 14 day period was determined. Plants were watered every three days over the course of the experiment. After 14 days, the plants were extracted from the soil and washed to remove excess debris. The plants were then inverted, exposed to 5% bleach for ten minutes, washed in water, exposed to hydrogen peroxide (10%) for ten minutes, washed again in water, and the stalks split with a sterile razor blade. The split halves of the stalks were placed face down onto nutrient agar plates for two hours. After two hours, the stalks were removed, and the agar plates incubated at 30° C. for 48 hours. After 48 hours, the plates were examined for colony morphology, and Bacillus cereus family member colonies found internal to the plant were toothpicked onto nutrient agar. These were then were grown overnight at 30° C. in brain heart infusion broth, and spun down at 10,000× g for 5 minutes. The supernatant was removed, and the pellet frozen overnight at −20° C. Chromosomal DNA was then extracted from each clone, the identity of each colony was verified by PCR using 16S rRNA primers, and amplicons were sent for DNA sequencing and identification. The 16S rRNA sequences for these strains are provided above in Table 18.

Example 24: Isolation, Identification, and Characterization of Additional Endophytic Bacterial Strains (Non-Bacillus cereus Family Members)

The endophytic bacterial strains Bacillus megaterium EE385, Bacillus sp. EE387, Bacillus circulans EE388, Bacillus subtilis EE405, Lysinibacillus fusiformis EE442, Lysinibacillus spp. EE443, and Bacillus pumilus EE-B00143 were isolated from corn seedlings. Two week old corn seedlings were first sterilized. The plants were extracted them from the soil and washed them to remove excess debris. The plants were then inverted, exposed to 5% bleach for ten minutes, washed in water, exposed to hydrogen peroxide (10%) for ten minutes, and washed again in water. The stalks were then split with a sterile razor blade. The split halves of the stalks were placed face down onto nutrient agar plates for two hours. After two hours, the plant stems were removed from the plates, and the plates were then incubated at 30° C. for 48 hours. Bacilli colonies that were endophytic were selected for further analysis. These strains were grown up in brain heart infusion broth overnight at 30° C., and the cultures subjected to extraction of DNA using a Qiagen Chromosomal DNA Kit. The DNA was PCR amplified to obtain the 16S rRNA gene, which was sent for DNA sequencing. The resultant sequences BLAST searched using the NCBI databases to establish the identity of the Bacilli species. The 16S rRNA sequences are provided above in Table 21.

Example 25: Additional Demonstration of the Utility of Endophytic Bacillus cereus Family Members to Deliver Peptides, Proteins, and Enzymes Endophytically to Plants Bacillus thuringiensis EE417, Bacillus thuringiensis EE-B00184, and Bacillus cereus EE439 were found to have the ability to grow endophytically (see Examples 23 and 24 above) and to be capable as serving as host strains for the BEMD system. To demonstrate the ability of these Bacilli to grow endophytically and to serve as a host strain for the BEMD system, each of these strains was transformed with the pMK4-BclA 20-35-eGFP plasmid, which encodes a fusion protein comprising amino acids 20-35 of BclA (amino acids 20-35 of SEQ ID NO: 1) fused in frame to eGFP. The transformed bacteria were then induced to sporulate by swabbing the bacteria onto nutrient agar plates and incubating the plates at 30° C. for 72 hours. After 72 hours, the bacterial spores were collected from the plate by swabbing into sterile phosphate buffered saline (PBS), and were purified by density centrifugation three times.

These spores were diluted to a concentration of $1\times10^8$/ml, and 1 µl of whole cell broth was then added to commercial hybrid corn seed in potting soil at planting. The corn seeds were coated with a fungicide and a biological inoculant. The corn hybrid variety was BECK 6175YE, which contains the ROUNDUP READY glyphosate resistance gene and AQUAMAX drought resistance gene. Plants were grown under artificial light for 14 hours a day and plant growth over a ten day period was determined. Plants were watered every three days over the course of the experiment.

Bacillus thuringiensis EE417, Bacillus thuringiensis EE-B00184, and Bacillus cereus EE439 expressing the BclA 20-35-eGFP fusion protein were then isolated from the inside of the corn plants. The ten day old plants were extracted from the soil and washed to remove excess debris. The plants were then inverted, washed in water, exposed to 5% bleach for ten minutes, washed in water, exposed to 70% ethanol for ten minutes, washed again in water, and the stalks split with a sterile razor blade. The split halves of the stalks were placed face down onto nutrient agar plates for two hours at 30° C. After two hours, the stalks were removed, and the agar plates incubated at 30° C. for 48 hours. After 48 hours, the plates were examined for colony morphology, and Bacillus colonies found internal to the plant were toothpicked onto nutrient agar and nutrient agar plus chloramphenicol plates (to select for bacteria containing the pMK4-20-35 BclA-eGFP plasmid). Results are shown in Table 49 below. These results demonstrate the ability of the BEMD system to be introduced into the target plant by expression in an endophytic strain of the *Bacillus cereus* family.

Figure 7:
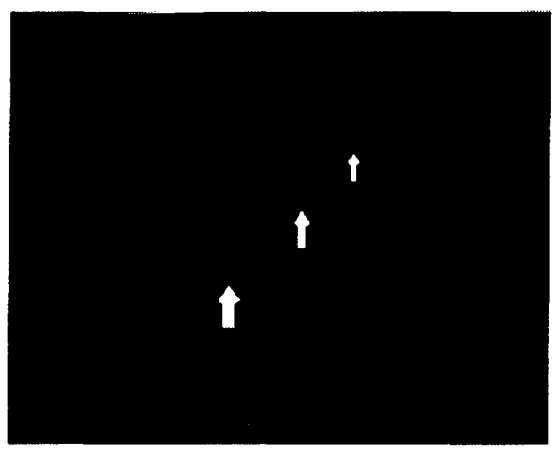

FIG. 7 also demonstrates the ability of *Bacillus thuringiensis* EE-B00184 to express eGFP on the spores, as evidenced by fluorescent microscopy. In FIG. 7, arrows denote single spores. To generate the image shown in FIG. 7, *Bacillus thuringiensis* EE-B00184 was transformed with pSUPER BclA 20-35 eGFP, and allowed to sporulate as described above. Spores were pelleted, washed, and subjected to fluorescence microscopy to demonstrate the spore surface laden with eGFP proteins in FIG. 7.

Figure 8:
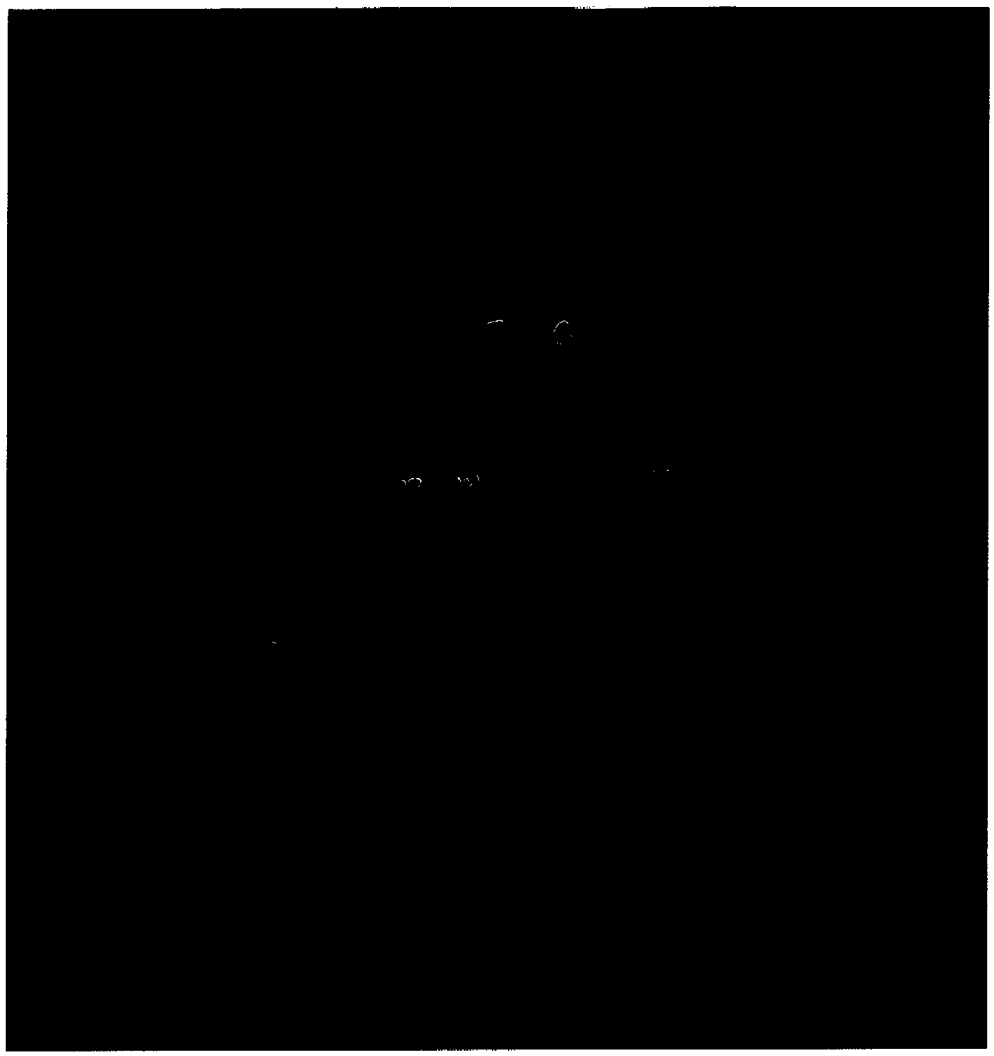

FIG. 8 demonstrates the ability of the isolated bacterial colonies from plants to fluoresce green, demonstrating that they do in fact deliver the protein of interest (herein eGFP) inside the plants. FIG. 8 shows fluorescence of colonies of endophytic bacteria isolated from inside corn plants on plates, illuminated with a GFP filtered lamp.

TABLE 49

Endophytic delivery of "cargo" proteins

| Strain | Endophytic | "Cargo" | % Bacillus colonies + for plasmid | % Bacillus colonies + for eGFP |
|---|---|---|---|---|
| Bacillus thuringiensis EE417 | Yes | BclA 20-35 eGFP | 29.8% | 29.8% |
| Bacillus thuringiensis EE-B00184 | Yes | BclA 20-35 eGFP | 38.9% | 38.9% |
| Bacillus cereus EE439 | Yes | BclA 20-35 eGFP | 23.9% | 23.9% |

To further demonstrate the ability of endophytic strain *Bacillus thuringiensis* EE-B00184 to express proteins on the surface of the spores, the pSUPER BclA-20-35-Endo construct described above in Example 4 was also introduced into *Bacillus thuringiensis* EE-B00184. Transformed cells were screen by PCR and Sanger sequencing. Spores were made by growing up an overnight culture in BHI plus selection (chloramphenicol), and 500 µl of each culture was swabbed onto nutrient broth agar plates and allowed to incubate at 30° C. for 3 days. After 3 days, the spores were swabbed off into PBS, diluted to a concentration of $1\times10^8$/ml, and spun down to recover the spores. Enzyme measurement of the spores was performed as described above in Example 4 and calculated as mU/ml for each construct. Results are shown in Table 50 below.

TABLE 50

Endophytic strain *Bacillus thuringiensis* EE-B00184 (EE-B00184) expressing fusion proteins

| Exosporium Protein or Targeting Sequence Fusion Partner | Host Endophytic Strain | Endoglucanase activity (mU/ml) |
|---|---|---|
| AA 20-35 of SEQ ID NO: 1 | EE-B00184 | 95.8 |

Endophytic strains can be administered to the plant through addition into the plant growth medium, including soil, irrigation, and granular formulations. Endophytic strains can also enter the target plant through the aerial portions of the plants. These strains create a unique and effective delivery mechanism for delivering proteins and peptides of interest into the plant.

Example 26: ACC Deaminase Enzyme Standardization on *Bacillus* Spore Preparations Two amino acids of the wild-type D-cysteine desulfhydrase of SEQ ID NO: 245 (from *Bacillus thuringiensis*; ID CODE: E195) were mutated to create SEQ ID NO: 249 (ID CODE: D406). These mutations are shown in underlined and bold text in SEQ ID NO: 249 in Table 3 above. Although the wild-type D-cysteine desulfhydrase of SEQ ID NO: 245 has ample inherent 1-aminocyclopropane-1-carboxylate deaminase (ACC deaminase/ACCD) activity, for purposes of the present Example and Examples 27 and 28 below, the wild-type D-cysteine desulfhydrase of SEQ ID NO: 245 is referred to as a "D-cysteine desulfhydrase," and the enzyme containing the mutations (SEQ ID NO: 249) will be referred to as an "ACC deaminase."

The wild-type (SEQ ID NO: 245) and mutant (SEQ ID NO: 249) enzymes were cloned into the pSUPER-BclA20-35 plasmid using the splicing by overlapping extension (SOE) technique. The pSUPER-BclA20-35 plasmid contains a PCR fragment which includes the BclA promoter (SEQ ID NO: 149), a start codon, and a coding sequence for amino acids 20-35 of BclA (amino acids 20-35 of SEQ ID NO: 1, the targeting sequence), fused in frame into the pSUPER plasmid. Thus, the following constructs were generated: pSUPER-BclA20-35-SEQ ID NO: 245 and pSUPER-BclA20-35-SEQ ID NO: 249. A six alanine linker was also included between the targeting sequence (amino acids 20-35 of BclA) and the D-cysteine desulfhydrase or ACC deaminase coding region.

In order to remove the *E. coli*-derived portions of the pSUPER plasmids and create smaller plasmids for expression in *Bacillus*, sequence-verified pSUPER constructs were amplified with primers that amplify the *Bacillus*-derived segment of the plasmid backbone. The resulting PCR products were self-ligated to generate the pBC plasmids (pBC-BclA20-35-SEQ ID NO: 245 and pBC-BclA20-35-SEQ ID NO: 249) that were used to transform the *Bacillus thuringiensis* BT013A exsY knock-out mutant strain described above in Example 10. Transformants were grown in broth overnight with tetracycline selection, and total DNA was collected using standard procedures. DNA was then subjected to Sanger sequencing to verify that each transformant contained the desired construct.

Non-transformed *Bacillus thuringiensis* BT013A exsY knockout spores and *Bacillus thuringiensis* BT013A exsY knockout spores transformed with each of the pBC-BclA20-35-SEQ ID NO: 245 and pBC-BclA20-35-SEQ ID NO: 249 constructs were grown at 30° to $1.8\text{-}1.9\times10^8$ spores per mL in yeast extract-based media for 64 hours. These sporulation cultures resulted in approximately 99% sporulation.

In order to standardize (ensure approximately equal enzyme activity for both constructs) the enzyme activities of the D-cysteine desulfhydrase (SEQ ID NOs. 245; ID CODE: E195) and the ACC deaminase (SEQ ID NO: 249; ID CODE: D406) for use in the plant studies described in Examples 27 and 28 below, ACC deaminase activity in *Bacillus* spore preparations was measured using a standard spectrophotometric dinitrophenol hydrazine assay (Li et al., *A colorimetric assay of* 1-*aminocyclopropane*-1-*carboxylate (ACC) based on ninhydrin reaction for rapid screening of bacteria containing ACC deaminase,* LETT APPL. MICROBIOL. 53 (2): 178-85 (2011). Specifically, ACC deaminase activity was measured based on formation of a ketobutyrate derivative formed via a two-step reaction. In the first step of the reaction, 1-aminocyclopropane-1-carboxylate (ACC) is deaminated to form α-ketobutyrate (α-KB) and ammonia:

In the second step of the reaction, α-KB is combined with 2,4-dinitrophenyl (DNP) hydrazine to form α-ketobutyric acid (2,4-dinitrophenyl) hydrazone:

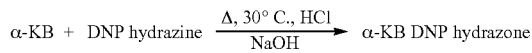

This hydrazone was then quantified spectrophotometrically by measuring its absorption at 540 nm. Conversion of amounts of α-KB to enzymatic activity was achieved by quantification using a α-KB standard curve (see FIG. 9).

100 μL of each spore sample (whole cell broth) was mixed with 100 μL 0.1 M Tris-HCl, pH 8.5 A dilution series of α-KB standards (50, 100, 500, 1000, and 2000 nM) was also prepared from a 10 mM solution of α-KB in 0.1 M Tris-HCl (pH 8.5). α-KB was purchased from Sigma-Aldrich (St. Louis, MO).

Spore samples, blanks and KB standards were then subjected to the two step ACCD activity assay described above. For the first reaction, 20 μL of 500 mM ACC or milliQ purified grade water was added to each spore sample or α-KB standard, respectively. The reaction tubes were vortexed and incubated at 30° C. in a heat block for 1 hour. The reaction was stopped by the addition of 1 mL of 0.56 M HCl (hydrochloric acid) to the reaction tubes followed by vortexing and centrifugation at maximum speed for 5 minutes.

The second reaction was initiated by transferring 1 mL volumes of the first reaction mixtures to 800 μL volumes of 0.56 M HCl in new 15 mL conical tubes. A volume of 300 μL of 0.2% (w/v) DNP hydrazine in 2.0 M HCl was added to each of the reaction tubes and the tubes were vortexed and incubated at 30° C. in a static incubator for 30 min. After the incubation, 1.0 mL of 2 M NaOH was added to each of the tubes and the tubes were vortexed again. The reactions were then allowed to stabilize for 10-20 seconds to ensure the colorimetric reaction ran to completion. A volume of 1 mL from each of the reactions was transferred to a polystyrene cuvette and read on a spectrophotometer at a wavelength of 540 nm. The absorbance reading of a true "blank" (0.1 M Tris buffer, pH 8.5) was subtracted from each reaction sample to generate the final absorbance used in data analysis.

Figure 9:
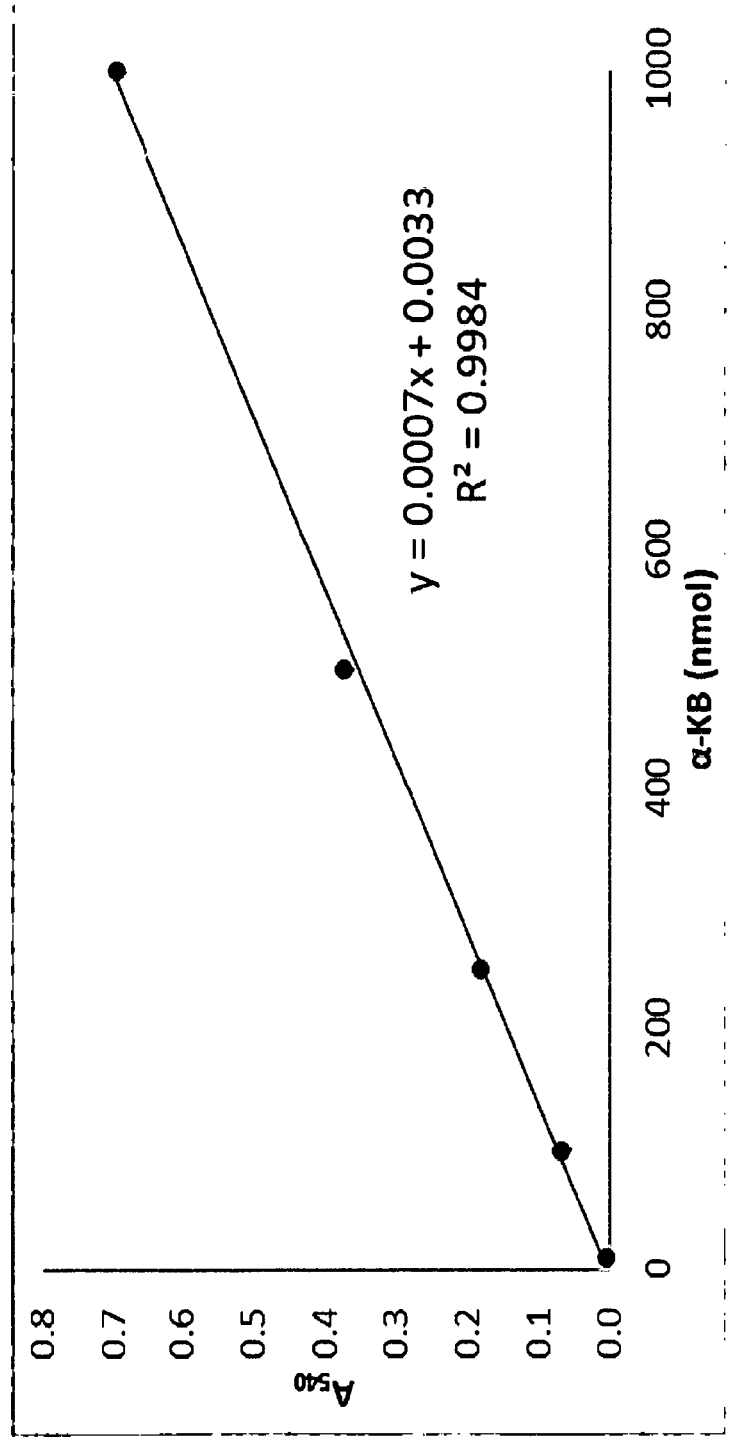

A standard curve was generated from the absorbance read from the α-KB standards and is shown in FIG. 9. In FIG. 9, the solid line is an artificial best fit line. Each data point used to create the best fit line represented an average absorbance (A540 nm) for two replicates for each of the reaction samples in the α-KB dilution series plotted against the starting concentration of α-KB. The enzyme activity of ACCD was calculated as 1 unit of ACCD activity equivalent to 1 μmol of α-KB released per 1 hour at 30° C. at pH 8.5.

Figure 10:
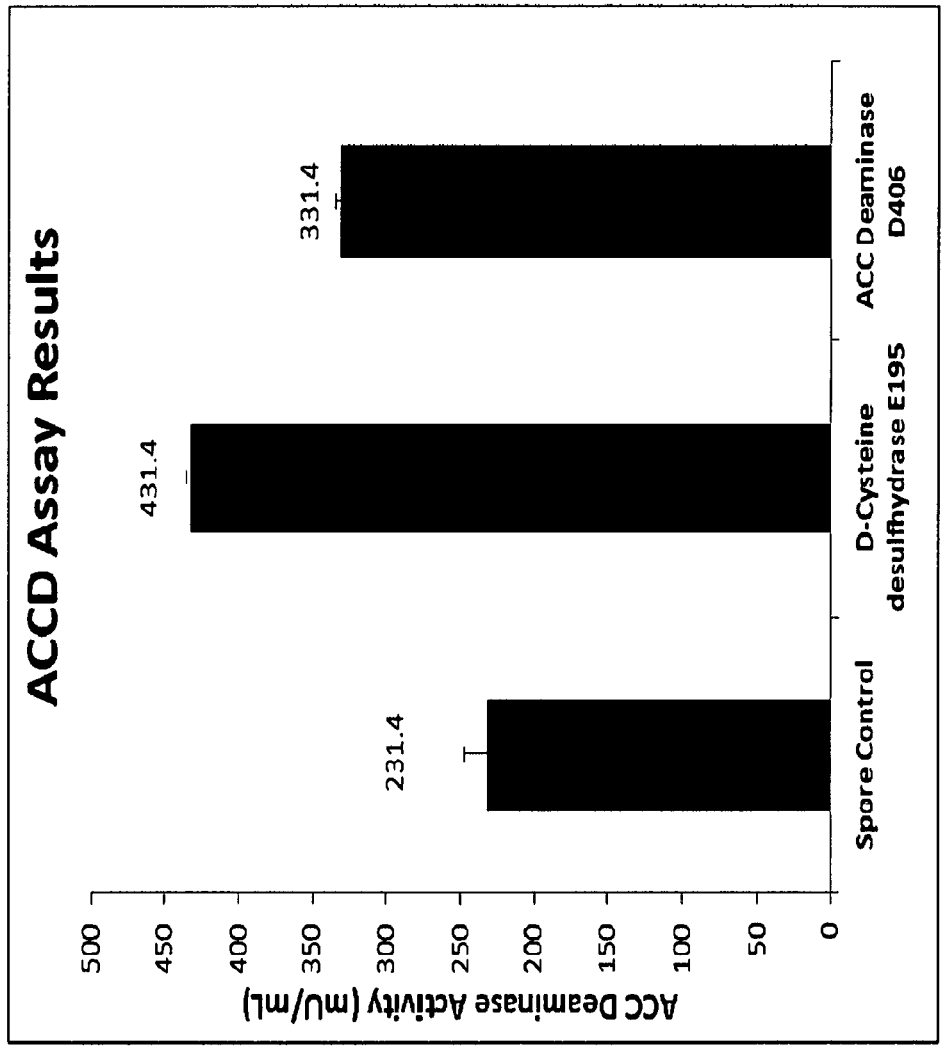
Figure 11:
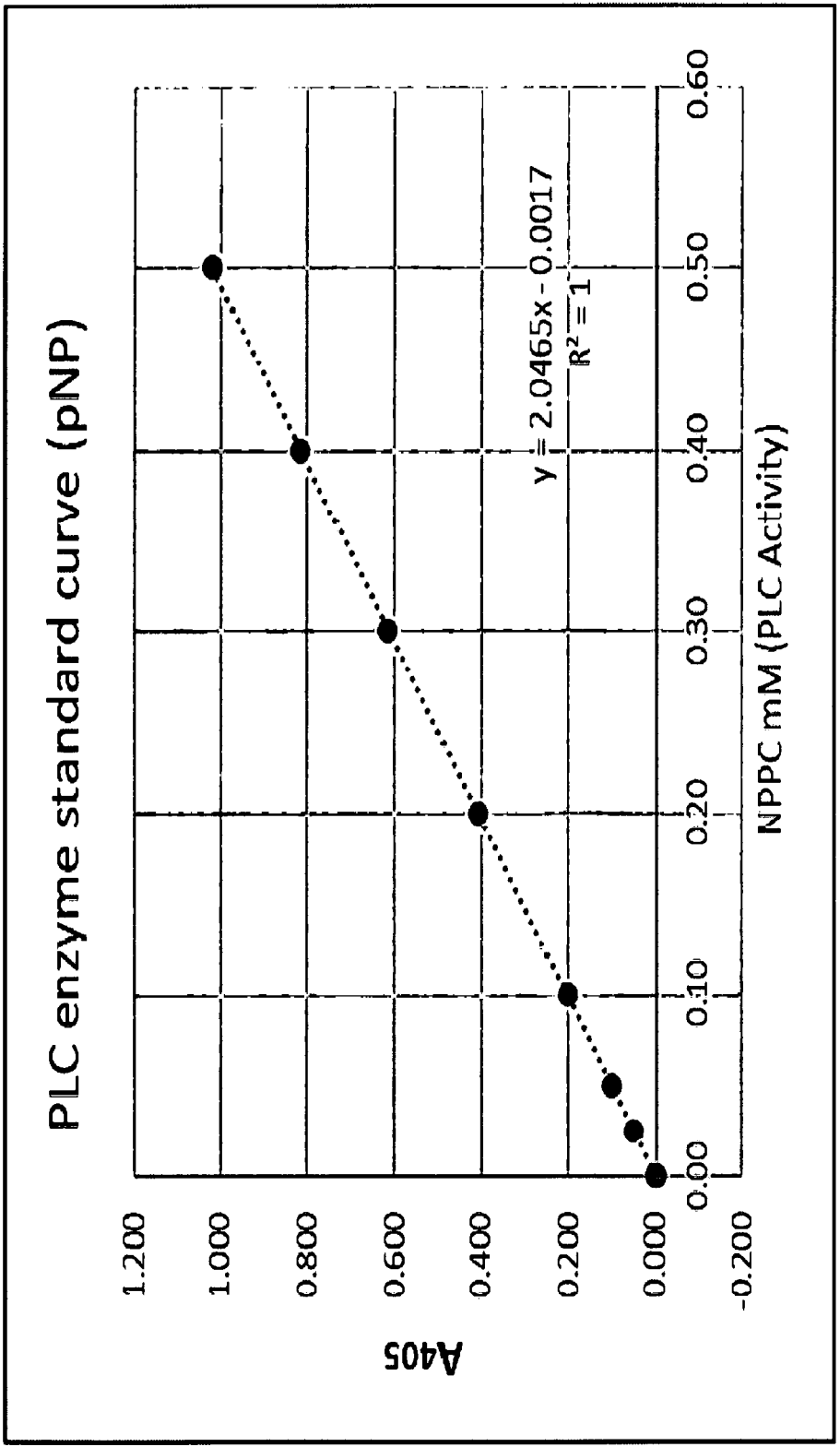

Enzyme activity for the non-transformed spores (background, spore control) and for spores transformed with the D-cysteine desulfhydrase (E195; SEQ ID NO: 245) and ACC deaminase (D406; SEQ ID NO: 249) constructs was measured using the ACCD activity assay. Results are shown in FIG. 10. Without being bound to any particular theory, it is believed that the slightly higher activity of the D-cysteine desulfhydrase E195 as compared to the ACC deaminase D406 that was observed in this assay may have been due to a difference in the CFU/ml for each enzyme (the CFU/ml for the ACC deaminase D406 was $1.54 \times 10^8$ CFU/mL whereas that for the D-cysteine desulfhydrase E195 was $2.18 \times 10^8$ CFU/mL) and/or the fact that the D-cysteine desulfhydrase E195 is known to be less active than the ACC deaminase D406 at pH 8.5, the pH at which the assay was performed.

Error bars in FIG. 10 represent the standard error based on a confidence interval of 95%. The activities of the E195 and D406 enzymes were standardized based on the ACCD activity assay to provide similar activities prior to foliar application to corn as described in Example 28 below.

Example 27: Foliar Treatment of Corn with ACC Deaminase

Non-transformed spores and spores transformed with the ACC deaminase construct pBC-BclA20-35-SEQ ID NO: 249 (D406) were prepared as described above in Example 26. These spores were applied as foliar treatments to two-week old corn plants (Beck's corn hybrid 5828 YH) at the V2 to V3 stage of development. Corn plants were grown from seed in an environmentally controlled growth room. Seed was planted directly into 39.7 cm³ pots containing Timberline #13 top soil at a depth of 2.54 cm, with 2 seeds per pot. After planting, 50 mL of room temperature water was added to each pot to allow for germination. The pots were kept in an artificial lighted growth room receiving approximately 300 μmol m$^{-2}$ s$^1$ (light photons) for a 12/12 light/day cycle and a 21° C. day/15° C. night temperature range. Plants received the same watering and fertilizer regimes.

At two weeks, spore preparations containing $1.8$-$1.9 \times 10^8$ total spores in 1 mL of water with 0.5% non-ionic surfactant (ALLIGARE SURFACE, Alligare LLC) were applied via foliar spray. The ALLIGARE SURFACE surfactant contains a blend of alkylpolyoxethylene, glycol derivatives, humectant, and formulation aids. Plants were treated with equal volumes of non-transformed spores (BEMD control solution) or spores expressing the D406 ACC deaminase. After treatment, the plants were placed under the same environmental growth conditions and allowed to grow an additional two weeks before growth parameters (shoot mass, root mass, and root length) were measured. Table 51 below summarizes the results and shows average shoot and root mass and root length normalized to water-treated controls for two trials (18 plants per trial). ACC deaminase (D406) applied as a foliar treatment modestly increased shoot mass (+2%), and substantially increased root mass (+10%) and root length (+11%).

TABLE 51

Effects of ACC deaminase on growth of corn, foliar application.

| Foliar Treatment Corn | Percentage average shoot mass (g), normalized to control | Percentage average root mass (g), normalized to control | Percentage average root length (cm), normalized to control |
|---|---|---|---|
| ACC deaminase D406 Trial 1 | 98% | 106% | 114% |
| ACC deaminase D406 Trial 2 | 105% | 113% | 108% |
| ACC deaminase D406 Average Trial 1 & 2 | 102% | 110% | 111% |

Example 28: Foliar Treatment of Corn with D-Cysteine Desulfhydrase and ACC Deaminase: Comparison of Intact Spores and Exosporium Fragments Non-transformed spores, as well as spores expressing either the ACC deaminase construct pBC-BclA20-35-SEQ ID NO: 249 (D406) or the D-cysteine desulfhydrase construct pBC-BclA20-35-SEQ ID NO: 245 (E195) were prepared and grown as described above in Example 26. An aliquot of each spore culture was collected and set aside (referred to in this Example as "intact spores"). The rest of each spore resultant culture was centrifuged for 5 minutes at 10,000×g to remove spores from the media. The remaining supernatant, which contains the exosporium fragments, was then filtered through a 0.22 µM syringe filter to remove any lingering spores. The supernatant containing the exosporium fragments was confirmed to be cell-free by plating onto nutrient agar for 48 hours at 30° C.

Corn plants (Beck's corn hybrid 5828 YH) were grown as described in Example 27 and were treated at two weeks (at the V2 to V3 stage of development) via foliar spray with exosporium fragments derived from non-transformed spores, exosporium fragments derived from spores expressing the D-cysteine desulfhydrase (SEQ ID NO: 245; ID CODE: E195), exosporium fragments derived from spores expressing the ACC deaminase (SEQ ID NO: 249; ID CODE D406), or intact spores expressing the ACC deaminase (SEQ ID NO: 249; ID CODE D406). Equivalent activities of D-cysteine desulfhydrase and ACC deaminase enzymes were delivered to each plant by preparing spore solutions containing $1.8$-$1.9 \times 10^8$ spores/mL prior to creation of exosporium fragments. Spores or exosporium fragments were then diluted in 10 mL water with 0.1% non-ionic surfactant (ALLIGARE SURFACE, Alligare LLC). 1 mL of the diluted spores or exosporium fragments was then applied foliarly to each plant.

At four weeks, growth parameters (root mass and root length) were measured and compared to control plants treated with exosporium fragments derived from non-transformed spores. Table 52 below summarizes the normalized shoot length, root mass, and length averaged across two trials. Data are normalized to results from plants treated with exosporium fragments derived from non-transformed spores. Foliar applications of exosporium fragments containing D-Cysteine desulfhydrase E195 or ACC deaminase D406 (exosporium fragments or intact spores) led to increases in root mass and root length. The foliar treatment using exosporium fragments containing D-cysteine desulfhydrase E195 resulted in a +9% increase in root mass and a +14% increase in root length. The foliar treatments using exosporium fragments or intact spores containing ACC deaminase (D406) resulted in similar increases in root mass and root length.

TABLE 52

Effects of D-cysteine desulfhydrase and ACC deaminase delivered using intact spores or exosporium fragments on growth of corn, foliar application

| Foliar Corn Treatment | Percentage average root mass (g) normalized to control | Percentage average root length (cm), normalized to control |
|---|---|---|
| D-cysteine desulfhydrase E195 (exosporium fragments) | 109% | 114% |
| ACC deaminase D406 (exosporium fragments) | 107% | 113% |
| ACC deaminase D406 (intact spores) | 110% | 111% |

Example 29: Bio-Activity Assays for Enzyme Optimization on *Bacillus* Spore Preparations The examples provided hereinbelow describe the use of the BEMD system to deliver various enzymes to plants via seed, in-furrow, or foliar treatment. Enzyme activities can be determined using substrate-specific spectrophotometric bioassays. Within each enzyme class, enzyme activities can be standardized so that approximately the same activity will be applied to the seeds, plants, or soil surrounding the plants. Illustrative enzyme activity assays that can be used for this purpose are described below.

β-1,3-Endoglucanase

β-1,3-Endoglucanase activity can be assessed by measuring the hydrolytic cleavage of the soluble β-1,3-glucan derivative carboxymethyl curdlan (CM-Curdlan). The cleavage of β-1,3 bonds liberates the reducing end of one of the two sugar monomers originally involved in the linkage. Liberated reducing ends are subsequently quantified by their reduction of 3,5-dinitrosalicylic acid (DNS) to 3-amino-5-nitrosalicylic acid, which can then be quantified spectrophotometrically by measuring its absorption at 540 nm. Conversion of the amounts of liberated reducing ends to enzymatic activity is achieved by quantification and comparison to a glucose standard curve that is generated using a pre-quantified, commercially available endoglucanase preparation as a standard.

β-1,4-Endoglucanase

β-1,4-Endoglucanase activity can be assessed by measuring the hydrolytic cleavage of the soluble β-1,4-glucan derivative carboxymethyl cellulose (CMC). The cleavage of β-1,4 bonds liberates the reducing end of one of the two sugar monomers originally involved in the linkage. Liberated reducing ends are subsequently quantified by their reduction of 3,5-dinitrosalicylic acid (DNS) to 3-amino-5-nitrosalicylic acid, which can then be quantified spectrophotometrically by measuring its absorption at 540 nm. Conversion of the amounts of liberated reducing ends to enzymatic activity is achieved by quantification and comparison to a glucose standard curve that is generated using a pre-quantified, commercially available endoglucanase preparation as a standard.

Chitosanase

Chitosanase activity can be assessed by measuring the hydrolytic cleavage of chitosan. The cleavage of β-1,4 bonds liberates the reducing end of one of the two glucosamine monomers originally involved in the linkage. Liberated reducing ends are subsequently quantified by their reduction of 3,5-dinitrosalicylic acid (DNS) to 3-amino-5-nitrosalicylic acid, which can then be quantified spectrophotometrically by measuring its absorption at 540 nm. Conversion of the amounts of liberated reducing ends to enzymatic activity is achieved by quantification and comparison to a glucose standard curve generated using a pre-quantified, commercially available chitosanase preparation as a standard.

Mannanase

Mannanase activity can be assessed by measuring the hydrolytic cleavage of galactomannan from carob (locust bean), which has a 22:78 ratio of galactose:mannose, with the mannose residues having β-1,4 linkages, and an α-1,6-linked galactose on every third mannose (in the middle mannose of the subunit). The cleavage of β-1,4 bonds liberates the reducing end of one of the mannose residues originally involved in the linkage. Liberated reducing ends are subsequently quantified by their reduction of 3,5-dinitrosalicylic acid (DNS) to 3-amino-5-nitrosalicylic acid, which can then be quantified spectrophotometrically by measuring by its absorption at 540 nm. Conversion of amounts of liberated reducing ends to enzymatic activity is achieved by quantification and comparison to a mannose standard curve generated using a pre-quantified commercially available mannanase enzyme.

Acid Phosphatase

Acid phosphatase activity can be assessed by measuring by the release of p-nitrophenol (pNP) from bis(4-nitrophenyl) phosphate [bNPP]. The cleavage of the phosphate bonds liberates two molecules of pNP from phosphate. The bNPP compound is colorless, whereas pNP is bright yellow and can be quantified spectrophotometrically by measuring its absorption at 405 nm under basic conditions. To optimize colorimetric detection, hydroxide can be added at the end of the enzymatic reaction in all enzyme standards, product standards, and samples. Conversion of absorbance to enzymatic activity is achieved by quantification and comparison to a pNP standard curve generated using a pre-quantified, commercially available acid phosphatase preparation as a standard.

Phospholipase C

Phospholipase C activity can be assessed by measuring the release of p-nitrophenol (pNP) from p-nitrophenylphosphorylcholine (NPPC). The cleavage of the phosphate bond liberates pNP from phosphorylcholine. The NPPC compound is colorless, whereas pNP is a bright yellow-green that can be quantified spectrophotometrically by measuring its absorption at 405-410 nm. Conversion of amounts of pNP to enzymatic activity is achieved by quantification and comparison to a pNP standard curve generated using a pre-quantified, commercially available phospholipase C preparation as a standard.

Lipase

Lipase activity can be assessed by measuring using p-nitrophenyl acyl esters (e.g. p-nitrophenyl palmitate) as chromogenic substrate analogs to provide for a continuous spectrophotometric assay. The lipolysis of p-nitrophenyl esters (laurates, palmitates, oleates) gives rise to the yellow colored p-nitrophenol, which can be quantified spectrophotometrically by measuring its absorbance of 405-410 nm. This assay provides a rapid and sensitive measurement to determine lipase activity (mU mL$^{-1}$) by measuring the yellow chromogen (p-nitrophenol) resulting from the hydrolysis of the substrate.

Xyloglucanase

Xyloglucanase activity can be assessed by measuring the cleavage or endo-hydrolysis of xyloglucan (tamarind). Liberated reducing ends are subsequently quantified by their reduction of 3,5-dinitrosalicylic acid (DNS) to 3-amino-5-nitrosalicylic acid, which can be quantified spectrophotometrically by measuring its absorption at 540 nm. Conversion of the amounts of liberated reducing ends to enzymatic activity is achieved by quantification and comparison to a glucose standard curve generated using a pre-quantified, commercially available xyloglucanase preparation (*Paenibacillus*, GH5) as a standard.

Other methods can also be used to determine xyloglucanase activity using substrate-specific assays. For example, as described in Ariza et al. (*Structure and activity of Paenibacillus polymyxa xyloglucanase from glycoside hydrolase Family* 44, J. Biol. Chem. 286(39): 33890-33900, 2011), xyloglucanase activity can be measured using the chromogenic substrate azurine cross-linked xyloglucan. The absorbance of the enzyme-reacted substrate is measured at 650 nm to quantify enzyme activity. Other substrate-specific assays of xyloglucanase activity use tamarind xyloglucan, carboxymethylcellulose, barley glucan, wheat arabinoxylan, or carob galactomannan as a substrate, with absorbance measurements of the enzyme-reacted substrates taken at 650 nm to quantify xyloglucanase activity.

Example 30: β-1,4-Endoglucanase Treatment of Corn

Constructs encoding fusion proteins containing β-1,4-endoglucanases were prepared using the same methods as described above in Example 26. Each of the constructs contained the BclA promoter (SEQ ID NO: 149), a start codon, a coding sequence for amino acids 20-35 of BclA (amino acids 20-35 of SEQ ID NO: 1), and a coding sequence for a β-1,4-endoglucanase. The β-1,4-endoglucanases used were as follows:

(1) The signal peptide of SEQ ID NO: 334, directly linked to the β-1,4-endoglucanase of SEQ ID NO: 293 (ID CODE E94);
(2) The β-1,4-endoglucanase of SEQ ID NO: 293, without any signal peptide (ID CODE: E112); and
(3) The signal peptide of SEQ ID NO: 334, directly linked to the β-1,4-endoglucanase of SEQ ID NO: 294 (ID CODE E113).

The β-1,4-endoglucanase of SEQ ID NO: 294 is a truncated version of the β-1,4-endoglucanase of SEQ ID NO: 293 wherein the carbohydrate-binding domain has been removed by truncating the last 167 amino acids of the protein. In each of these constructs, a five alanine linker was also included between the targeting sequence (amino acids 20-35 of BclA) and β-1,4-endoglucanase.

The construct containing the signal peptide of SEQ ID NO: 334 directly linked to the β-1,4-endoglucanase of SEQ ID NO: 293 was cloned into a tetracycline resistance-conferring plasmid. This plasmid (pBCm-BclA20-35) was derived from the pBC16 *Bacillus cereus* plasmid and contains the origin of replication and tet resistance gene from pBC16. The resulting plasmid and the host strain expressing the plasmid were given the ID code E94.

The construct containing the β-1,4-endoglucanase of SEQ ID NO: 293, without any signal peptide, was cloned into the tetracycline-resistance conferring pBCm-BclA20-35 plasmid. The resulting plasmid and the host strain expressing the plasmid were given the ID code E112.

The construct containing the signal peptide of SEQ ID NO: 334, directly linked to the β-1,4-endoglucanase of SEQ ID NO: 294, was cloned into the tetracycline-resistance conferring pBCm-BclA20-35 plasmid. The resulting plasmid and the host strain expressing the plasmid were given the ID code E113.

Each of the constructs in the tetracycline-resistance conferring pBCm-BclA20-35 plasmid was transformed into wild-type *Bacillus thuringiensis* BT013A and spores were generated as described above in Example 26.

Spores expressing each of the constructs were applied to corn (Beck's corn hybrid 5828 NR) in-furrow treatments using 1 μL volumes of spore preparations and a spore concentration of $1.8\text{-}1.9\times10^8$ spores per mL (from cultures that resulted in approximately 99% sporulation). For in-furrow treatment, 1 μL of the spore preparation was diluted into 1 mL of water, which was then applied to the soil surrounding the seed at the time of planting.

Plants were grown in an environmentally controlled growth room under the same conditions described above in Example 27. Plant height was measured at two weeks and normalized to control plants treated with water alone. Results are provided in Table 53 below as plant height normalized to control averaged across three trials (18 plants per trial).

TABLE 53

Effects of β-1,4-endoglucanase effect on plant height for corn, in- furrow treatment

| Corn Treatment | Percentage average plant height (cm), normalized to control (In Furrow) |
|---|---|
| β-1,4-endoglucanase E94 | 111% |
| β-1,4-endoglucanase E112 | 120% |
| β-1,4-endoglucanase E113 | 119% |

In-furrow treatment with the β-1,4-endoglucanase enzymes (E94, E112, and E113) all increased plant height over control, by +11%, +20% and +19%, respectively (Table 53).

Example 31: Seed Treatment of Corn with Lichenase

A construct encoding a fusion protein containing a lichenase was prepared using the same methods as described above in Example 26. The construct contained the BclA promoter (SEQ ID NO: 149), a start codon, a coding sequence for amino acids 20-35 of BclA (amino acids 20-35 of SEQ ID NO: 1), and a coding sequence for a lichenase. The lichenase contained the signal peptide of SEQ ID NO: 335, directly linked to the lichenase of SEQ ID NO: 295. This construct was cloned into the tetracycline-resistance conferring pBCm-BclA20-35 plasmid described above in Example 30 and given the ID code E111. This plasmid was transformed into wild-type *Bacillus thuringiensis* BT013A and spores were generated as described above in Example 26.

In two separate experiments, corn seeds (Beck's corn hybrid 5828 NR) were treated with 1 μL of spores expressing the lichenase E111 enzyme or β-1,4-endoglucanase E94 (Experiment 1) or with only with spores expressing the lichenase E111 (Experiment 2). The β-1,4-endoglucanase E94 constructs is described above in Example 30. Seed treatment was conducted as described above in Example 30.

Plants were grown in a controlled growth environment under the same conditions as described above in Example 27. Plant height was measured at two weeks. Results are shown in Tables 54 and 55 below as average plant height normalized to a water-only control for each trial in each experiment. Each experiment involved two replicate trials using 18 plants per trial.

The lichenase enzyme applied as a seed treatment increased plant height by 5-6% in both experiments as compared to control (water treated) plants (Tables 54 and 55).

TABLE 54

Seed treatment with lichenase, effect on plant height for corn

| Seed Treatment Corn | Percentage average plant height (cm) normalized to control Trial 1 | Percentage average plant height (cm) normalized to control Trial 2 | Percentage average plant height (cm) normalized to control Trials 1 & 2 |
|---|---|---|---|
| β-1,4-endoglucanase E94 | 102.4% | 101.4% | 101.9% |
| Lichenase E111 | 108.4% | 102.4% | 105.4% |

TABLE 55

Seed treatment with lichenase, effect on plant height for corn

| Seed Treatment Corn | Percentage average plant height (cm) normalized to control Trial 1 | Percentage average plant height (cm) normalized to control Trial 2 | Percentage average plant height (cm) normalized to control Trials 1 & 2 |
|---|---|---|---|
| Lichenase E111 | 112.2% | 100.3% | 106.3% |

Example 32: In-Furrow Treatment of Corn with Lichenase

Spores expressing the E111 lichenase described above in Example 31 or the 3-1,4-endoglucanase E94 described above in Example 30 were applied in-furrow to corn (Beck's corn hybrid 5828 NR). One microliter of each spore preparation was diluted into 1 mL of water. The diluted spores were then applied to the soil surrounding the seeds at the time of planting. Plants were grown in an environmentally controlled growth room under the same conditions as described above in Example 27. After two weeks of growth, plant height was measured and compared to water-treated controls. Results are provided in Table 56 below as plant height normalized to control averaged across three trials (18 plants per trial).

In-furrow treatments using lichenase (E111) and β-1,4-endoglucanase (E94) both increased plant growth. In-furrow application of lichenase (E111) increased plant height by +13% while β-1,4-endoglucanase E94 increased plant height by +11% as compared to water-treated controls.

TABLE 56

In-furrow application of lichenase increases plant height for corn

| In-Furrow Treatment, Corn | Percentage average plant height (cm), normalized to control |
|---|---|
| β-1,4-endoglucanase E94 | 111% |
| Lichenase E111 | 113% |

Example 33: Seed Treatment of Corn with Xyloglucanase

Constructs encoding fusion proteins containing xyloglucanases were prepared as described above in Example 26.

Each of the constructs contained the BclA promoter (SEQ ID NO: 149), a start codon, a coding sequence for amino acids 20-35 of BclA (amino acids 20-35 of SEQ ID NO: 1), and a coding sequence for a xyloglucanase. The xyloglucanase used were as follows:
 (1) The xyloglucanase of SEQ ID NO: 300, without any signal peptide (xyloglucanase XG12, *Bacillus licheniformis* ID CODE: E149); and
 (2) The xyloglucanase of SEQ ID NO: 299, without any signal peptide (xyloglucanase XG5, *Paenibacillus pabuli*; ID CODE: D381).

These constructs were cloned into the tetracycline-resistance conferring pBCm-BclA20-35 plasmid described above in Example 30. These plasmids were then transformed into wild-type *Bacillus thuringiensis* BT013A and spores were generated as described above in Example 26.

Corn seed (Beck's corn hybrid 5828 NR) was treated with 1 μL of the spore preparations using the method described above in Example 30. Seeds were planted and plants were grown in an environmentally controlled growth room under the same conditions as described above in Example 27. Plant height was measured at two weeks and compared to water-treated controls. Results are summarized in Table 57 below as plant height normalized to control averaged across three trials (18 plants per trial). Both xyloglucanase enzymes increased plant height, by +5% for E149 and +3% for D381, compared to control (Table 57).

TABLE 57

Seed treatment with xyloglucanase increases plant height in corn

| Corn Seed Treatment | Percentage average plant height (cm), normalized to control |
|---|---|
| Xyloglucanase E149 | 105% |
| Xyloglucanase D381 | 103% |

Example 34: Seed Treatment of Corn with Xylanase

Constructs encoding fusion proteins containing xylanases were prepared as described above in Example 26. Each of the constructs contained the BclA promoter (SEQ ID NO: 149), a start codon, a coding sequence for amino acids 20-35 of BclA (amino acids 20-35 of SEQ ID NO: 1), and a coding sequence for a xylanase. The xylanases used were as follows:

(1) The signal peptide of SEQ ID NO: 328, directly linked to the xylanase of SEQ ID NO: 268 (ID CODE: E100); and (2) The xylanase of SEQ ID NO: 268, without any signal peptide (ID CODE: E146).

These constructs were cloned into the tetracycline-resistance conferring pBCm-BclA20-35 plasmid described above in Example 30. These plasmids were then transformed into wild-type *Bacillus thuringiensis* BT013A and spores were generated as described above in Example 26.

Corn seed (Beck's corn hybrid 5828 NR) was treated as described in Example 30 using 1 μL of each of the spore preparations. Seeds were planted and plants were grown in an environmentally controlled growth room under the same conditions as described above in Example 27. Plant height was measured at two weeks and compared to water-treated controls. Results are summarized in Table 58 below as normalized plant height averaged across three trials (18 plants per trial). Seed treatment with the two xylanase (XynA) enzymes resulted in different effects on plant growth. Xylanase E100 showed a +7% increase in plant height over the control corn plants.

TABLE 58

Effects of seed treatment with xylanase on plant height in corn

| Seed Treatment Corn | Percentage average plant height (cm) normalized to control |
|---|---|
| Xylanase E100 | 107% |
| Xylanase E146 | 97% |

Example 35: Seed Treatment of Soybean with Xylosidase

Constructs encoding fusion proteins containing xylosidases were prepared as described above in Example 26. Each of the constructs contained the BclA promoter (SEQ ID NO: 149), a start codon, a coding sequence for amino acids 20-35 of BclA (amino acids 20-35 of SEQ ID NO: 1), and a coding sequence for a xylosidase. The xylosidases used were as follows:

(1) The xylosidase of SEQ ID NO: 276 (ID CODE: E175); and (2) The xylosidase of SEQ ID NO: 275 (ID CODE E194).

These constructs were cloned into the tetracycline-resistance conferring pBCm-BclA20-35 plasmid described above in Example 30. These plasmids were then transformed into wild-type *Bacillus thuringiensis* BT013A and spores were generated as described above in Example 26.

These xylosidase constructs and the β-1,4-endoglucanase E94 construct described above in Example 30 were tested for their effects as seed treatments on soybean. Soybean seeds (MorSoyXtra 38X52) were treated with 1 μL of each of the spore preparations by pipetting 1 μL of the spore preparation directly onto each seed and allowing it to dry. Treated seeds were then grown in an environmentally controlled room. Seeds were planted directly into 39.7 $cm^3$ pots containing Timberline #13 top soil at a depth of 2.54 cm, with 2 seeds per pot. After planting, 50 mL of room temperature water was added to each pot to allow for germination. The pots were kept in an artificial lighted growth room receiving approximately 300 μmol $m^{-2}$ $s^1$ (light photons) for a 12/12 light/day cycle and a 21° C. day/15° C. night temperature range. Plants received the same watering and fertilizer regimes. After 4-5 weeks, plants were measured for changes in dry biomass parameters (total weight and above ground weight). Biomass results are summarized in Table 59 as normalized to control plants grown from water-treated seeds, averaged across two trials (18 plants per trial).

When compared to control plants, β-1,4-endoglucanase (E94) enzyme increased the average total dry weight by +45% and the above ground dry soybean biomass by +66%. Xylosidase (E175), on average, increased total dry biomass by +15% and the above ground dry biomass by +23%.

TABLE 59

Effects of seed treatment with xylosidase on biomass in soybean

| Seed Treatment Soybean, Dry Weight | Percentage average total weight (g), normalized to control | Percentage average above ground weight (g), normalized to control |
|---|---|---|
| β-1,4-endoglu-canase E94 | 145% | 166% |
| Xylosidase E175 | 115% | 123% |
| Xylosidase E194 | 92% | 94% |

Example 36: Effect of Xylosidase on Soybean Fractional Green Canopy Cover (FGCC)

The xylosidase constructs described above in Example 35 were also tested for their effects on fractional green canopy cover (FGCC) in soybeans. FGCC is a key diagnostic image analysis measure used to estimate canopy development, and provides a means to predict light interception and evapotranspiration from plant leaf surfaces. The Canopeo FGCC mobile application provides a comparison of red to green (R/G) and blue to green (B/C) color ratios and provides a nondestructive measure of green canopy cover. The result of the analysis is a binary image where white pixels correspond to the pixels that satisfy the selection criteria (green canopy) and black pixels correspond to the pixels that did not match the criteria (not green canopy). Fractional green canopy (green band ~500-570 nm) covers ranges from 0 (no green canopy) to 1 (100% green canopy cover) (Patrignani A. et al., *Canopeo: A powerful new tool for measuring fractional green canopy cover*, BIOMETRY, MODELING AND STATISTICS 107: 2312-2320, 2015).

Soybean seeds (MorSoyXtra 38X52) were treated as described in Example 35 with 1 µL of each xylosidase spore preparations or with the β-1,4-endoglucanase E94 spore preparation described above in Example 30. Plants were grown in an environmentally controlled growth room under the same conditions as described above in Example 35. At the trifoliate leaf stage, FGCC was measured to quantify canopy size and overall "greenness." Results are summarized in Table 60. Table 60 provides the FGCC parameters and normalized responses compared to water-treated controls averaged across two trials (18 plants per trial). Xylosidase (E175) seed treatment enhanced greenness compared to water-treated controls. Xylosidase (E175) seed treatment resulted in increases of +13% (Trial 1) and +7% (Trial 2) of the FGCC-calculated parameter. Thus, xylosidase (E175) may have positive impacts for increasing a "stay green" phenotype in soybean especially during the grain and pod filing stages of development, enabling more assimilation and carbohydrate transfer during these two stages to increase overall yield.

Example 37: Effects of Seed Treatment with Xylosidase on Nodulation in Soybean

The xylosidase constructs described above in Example 35 and the β-1,4-endoglucanase E94 described above in Example 30 were also tested for their effects on nodulation in soybeans. Soybean seeds (MorSoyXtra 38X52) were treated as described in Example 35 with 1 µL of each of the xylosidase spore preparations or with the β-1,4-endoglucanase E94 spore preparation. At 4-5 weeks, nodules were counted and normalized to results from control plants grown from water-treated seeds. The results are summarized in Table 61 below as the normalized nodule count averaged across two trials (18 plants per trial). Seed treatment with xylosidase (E175) or β-1,4-endoglucanase (E94) increased the number of nodules per plant by +5% and +9%, respectively, as compared to control plants.

TABLE 61

Effects of seed treatment with xylosidase on early nodulation in soybean

| Seed Treatment, Soybean | Percentage average nodules per plant, normalized to control |
|---|---|
| β-1,4-endoglucanase E94 | 109% |
| Xylosidase E175 | 105% |
| Xylosidase E194 | 99% |

Example 38: Seed Treatment of Corn with Mannanase

Constructs encoding fusion proteins containing mannanases were prepared as described above in Example 26. Each of the constructs contained the BclA promoter (SEQ ID NO: 149), a start codon, a coding sequence for amino acids 20-35 of BclA (amino acids 20-35 of SEQ ID NO: 1), and a coding sequence for a mannanases. The mannanases used were as follows:
(1) The mannanase of SEQ ID NO: 308, without any signal peptide (ID CODE: E177); and
(2) The mannanase of SEQ ID NO: 307, without any signal peptide (ID CODE: E196).
These constructs were cloned into a the tetracycline-resistance conferring pBCm-BclA20-35 plasmid described above in Example 30. These plasmids were then transformed into wild-type *Bacillus thuringiensis* BT013A and spores were generated as described above in Example 26.

Corn seeds (Beck's hybrid 5828 YH) were treated as described in Example 30 with 1 µL of each of the mannanase spore preparations. Seeds were planted and plants were grown in an environmentally controlled growth room under

TABLE 60

Effects of seed treatment with xylosidase on fractional green canopy cover (FGCC) in soybean

| Seed Treatment Soybean | Average FGCC Canopy Coverage Trial 1 | Percentage average change in FGCC per plant normalized to control Trial 1 | Average FGCC Canopy Coverage Trial 2 | Percentage average change in FGCC per plant normalized to control Trial 2 |
|---|---|---|---|---|
| Control (Water) | 0.844 | — | 0.912 | — |
| Xylosidase E175 | 0.951 | 113% | 0.973 | 107% |
| Xylosidase E194 | 0.622 | 74% | 0.673 | 74% | the same conditions as described above in Example 27. Plant height was measured at two weeks and compared plants grown from to water-treated control seeds. Results are summarized in Table 62 as normalized plant height averaged across two trials (18 plants per trial).

Seed treatment with the mannanase enzymes E177 and E196 promoted plant growth as measured by plant height. Mannanase E177 resulted in a +14% increase and mannanase E196 resulted in a +5% increase in plant height as compared to the control.

TABLE 62

Seed treatment application of mannanase increases plant height for corn

| Seed Treatment Corn | Percentage average plant height (cm) normalized to control |
|---|---|
| Mannanase E177 | 114% |
| Mannanase E196 | 105% |

Example 39: Seed Treatment of Soybean with Mannanase

The mannanase constructs described above in Example 38 and the β-1,4-endoglucanase E94 construct described in Example 30 above were also tested for their effects on plant growth in soybean when applied as seed treatments.

Soybean seeds (MorSoyXtra 38X52) were treated as described in Example 35 with 1 μL of each of the mannanase spore preparations or with the β-1,4-endoglucanase E94 spore preparation. Seeds were planted and plants were grown in an environmentally controlled growth room under the same conditions as described above in Example 35. Growth measurements (dry biomass and nodulation) were taken at 4-5 weeks and normalized to control plants grown from water-treated seeds. Tables 63 and 64 below summarize normalized results averaged from two trials (12 plants per trial)

TABLE 63

Effects of seed treatment with mannanase effect on dry weight in soybean

| Seed Treatment Soybean, Dry Weight | Percentage average total weight (g), normalized to control | Percentage average above ground weight (g), normalized to control |
|---|---|---|
| β-1,4-endoglucanase E94 | 145% | 166% |
| Mannanase E177 | 110% | 113% |
| Mannanase E196 | 121% | 130% |

As shown in Table 63, seed treatment with β-1,4-endoglucanase (E94) enzyme increased total dry weight by +45% and above ground dry soybean biomass by +66% compared to the control treatment. Mannanase (E177) increased total dry biomass by +10% and increased the total dry above ground biomass by +13% compared to the control plants. Mannanase (E196) increased total dry biomass by +21% and the total dry above ground biomass by +30% compared to controls.

TABLE 64

Effects of seed treatment with mannanase on early nodulation in soybean

| Seed Treatment, Soybean Early Nodulation | Percentage average nodules per plant normalized to control |
|---|---|
| β-1,4-endoglucanase E94 | 109% |
| Mannanase E177 | 109% |
| Mannanase E196 | 106% |

As shown in Table 64, seed treatment with mannanase E177 resulted in a +9% increase in nodule count per plant and treatment with mannanase E196 resulted in a +6% increase in nodule count per plant, as compared to the negative control. Mannanase E177 resulted in equivalent increases in nodule count per plant relative to β-1,4-endoglucanase E94.

Example 40: Seed Treatment of Corn with Pectin-Degrading Enzymes

Constructs encoding fusion proteins containing pectin-degrading enzymes were prepared as described above in Example 26. Each of the constructs contained the BclA promoter (SEQ ID NO: 149), a start codon, a coding sequence for amino acids 20-35 of BclA (amino acids 20-35 of SEQ ID NO: 1), and a coding sequence for a pectin-degrading enzyme. The pectin-degrading enzyme used were as follows:
  (1) The pectin lyase of SEQ ID NO: 310 (ID CODE: E176); and
  (2) The signal peptide of SEQ ID NO: 346, directly linked to the endopolygalacturonase of SEQ ID NO: 309 (ID CODE: D405).

These constructs were cloned into the tetracycline-resistance conferring pBCm-BclA20-35 plasmid described above in Example 30. These plasmids were then transformed into wild-type *Bacillus thuringiensis* BT013A and spores were generated as described above in Example 26.

Corn seeds (Beck's hybrid 5828 YH) were treated as described in Example 30 with 1 μl of each of the pectin-degrading enzyme spore preparations. Seeds were planted and plants were grown in an environmentally controlled growth room under the same conditions as described above in Example 27. At two weeks, plant height was measured and normalized to control plants grown from water-treated seeds. The results are summarized in Table 65 as the average plant height normalized to control across two trials (18 plants per trial). Both of the pectin degrading enzymes, E176 and D405, showed similar effects as seed treatments in corn, resulting in a +1% increase in plant height as compared to the control treatment.

TABLE 65

Effects of seed treatment with pectin-degrading enzymes on plant height in corn

| Corn Seed Treatment | Percentage average plant height (cm) normalized to control |
|---|---|
| Pectin lyase E176 | 101% |
| Endopolygalacturonase D405 | 101% |

Example 41: Seed Treatment of Soybean with Pectin-Degrading Enzymes

The constructs containing the pectin-degrading enzymes were also tested for their effects on soybeans when applied as a seed treatment. Soybean seeds (MorSoy Xtra 38X52) were treated as described in Example 35 with 1 µl of each of the pectin-degrading enzyme spore preparations or with the β-1,4-endoglucanase E94 spore preparation described above in Example 30. Seeds were planted and plants were grown in an environmentally controlled growth room under the same conditions as described above in Example 35. At 4-5 weeks, measurements of dry biomass and nodulation were obtained and compared to control plants grown from water-treated seeds. Tables 66 and 67 summarize normalized biomass and nodulation measurements averaged across 3 trials (18 plants per trial).

Dry weight differences for total dry weight and above ground dry weight or biomass (grams) were increased over the control treatment for both of the pectin-degrading enzymes (E176 and D405). Pectin lyase (E176) increased total dry biomass by +16% and increased total above ground dry biomass by +25%, whereas endopolygalacturonase (D405) resulted in average increases of +25% for total dry biomass, and a +42% increase for total above ground dry biomass as compared to the control treatment (Table 66). The β-1,4-endoglucanase (E94) enzyme applied as a seed treatment to soybean resulted in a positive increase in total dry biomass (+45%) and also in above-ground dry soybean biomass (+66%) as compared to the control treatment.

TABLE 66

Effects of seed treatment with pectin-degrading enzymes on dry weight in soybean.

| Seed Treatment Soybean, Dry Weight | Percentage average total weight (g), normalized to control | Percentage average above ground weight (g), normalized to control |
| --- | --- | --- |
| β-1,4-endoglucanase E94 | 145% | 166% |
| Pectin lyase E176 | 116% | 125% |
| Endopolygalact-uronase D405 | 125% | 142% |

Soybean plants grown from seeds treated with β-1,4-endoglucanase E94 had on average a +9% increase in nodules per plant compared to the control plants grown from water-treated seeds (Table 67). Seed treatment with the pectin lyase E176 resulted in an average +2% increase in nodules per plant compared to control plants.

TABLE 67

Effects of seed treatment with pectin-degrading enzymes on early nodulation in soybean

| Seed Treatment Soybean Early Nodulation | Percentage average nodules per plant, normalized to control |
| --- | --- |
| β-1,4-endoglucanase E94 | 109% |
| Pectin lyase E176 | 102% |
| Endopolygalacturonase D405 | 95% |

Example 42: Activity of Phospholipase C on Spores

Constructs encoding fusion proteins containing phospholipase C (PLC) enzymes were prepared as described above in Example 26. Each of the constructs contained the BclA promoter (SEQ ID NO: 149), a start codon, a coding sequence for amino acids 20-35 of BclA (amino acids 20-35 of SEQ ID NO: 1), and a coding sequence for a PLC. The PLC enzymes used were as follows:

(1) The signal peptide of SEQ ID NO: 317, directly linked to the phospholipase C of SEQ ID NO: 250 (ID CODES: E95 and E62);

(2) The phospholipase C of SEQ ID NO: 250, without any signal peptide; and (3) The phospholipase C of SEQ ID NO: 251, without any signal peptide.

SEQ ID NO: 251 lacks the propeptide that is present in SEQ ID NO: 250, and thus comprises only the catalytic domain of the PLC.

Table 68 below shows the domains included in these constructs and Table 69 provides a depiction of the arrangement of the domains within each construct.

TABLE 68

Element domain designations for PLC constructs

| Construct Element Domains | Element abbreviation |
|---|---|
| bclA promoter (SEQ ID NO: 149) | bclAP |
| bclA aa20-35 targeting sequence (amino acids 20-35 of SEQ ID NO: 1) | bclAt |
| plc signal peptide (SEQ ID NO: 317) | plc-sp |
| plc propeptide (SEQ ID NO: 261) | plc-pp |
| plc catalytic domain (SEQ ID NO: 251) | plc-cc |

TABLE 69

Constructs used for expressing phospholipase C

| Phospholipase C Treatments | Construct Descriptions |
|---|---|
| Phospholipase C E62 | [bclAP::bclAt::plc-sp::plc-pp::plc-cc] |
| Phospholipase C E95 | [bclAP::bclAt::plc-sp::plc-pp::plc-cc] |
| Phospholipase C E143 | [bclAP::bclAt::plc-pp::plc-cc] |
| Phospholipase C E144 | [bclAP::bclAt::plc-cc] |

The E95, E143, and E144 constructs were cloned into the tetracycline-resistance conferring pBCm-BclA20-35 plasmid described above in Example 30. The E62 construct was cloned into pBC-BclA20-35 plasmid, which contains a 200 bp additional piece of DNA that is removed in pBCm and does not add any value to the plasmid. The resulting plasmids were then transformed into *Bacillus thuringiensis* BT013A and spores were generated as described above in Example 26.

The activity of the PLC enzymes on the surface of the spores was then evaluated by measuring the release of p-nitrophenol (pNP) from a p-nitrophenylphosphorylcholine (NPPC) substrate (Carbosynth, product code #EN26341). The NPPC compound is colorless, whereas pNP is a bright yellow-green and can be quantified spectrophotometrically by measuring its absorption at 405-410 nm. Production of one mol of pNP in one minute is equivalent to 1 unit of PLC activity.

A standard curve was first generated using commercially available pNP (Acros Organics, product code #157050050). To generate the standard curve, solutions containing varying pNP concentrations ranging from 0.025 mM to 0.50 mM in 100 mM HEPES buffer pH 7.0 were prepared. The absorption of each sample at 405 nm was then measured using a spectrophotometer. The standard curve is shown in FIG. 11. In FIG. 11, the dotted line is an artificial best fit line. Each data point used to create the best fit line represents an average absorbance (A405 nm) for three replicates of each of the sample solutions plotted against the adjusted concentration of commercial pNP.

Figure 12:
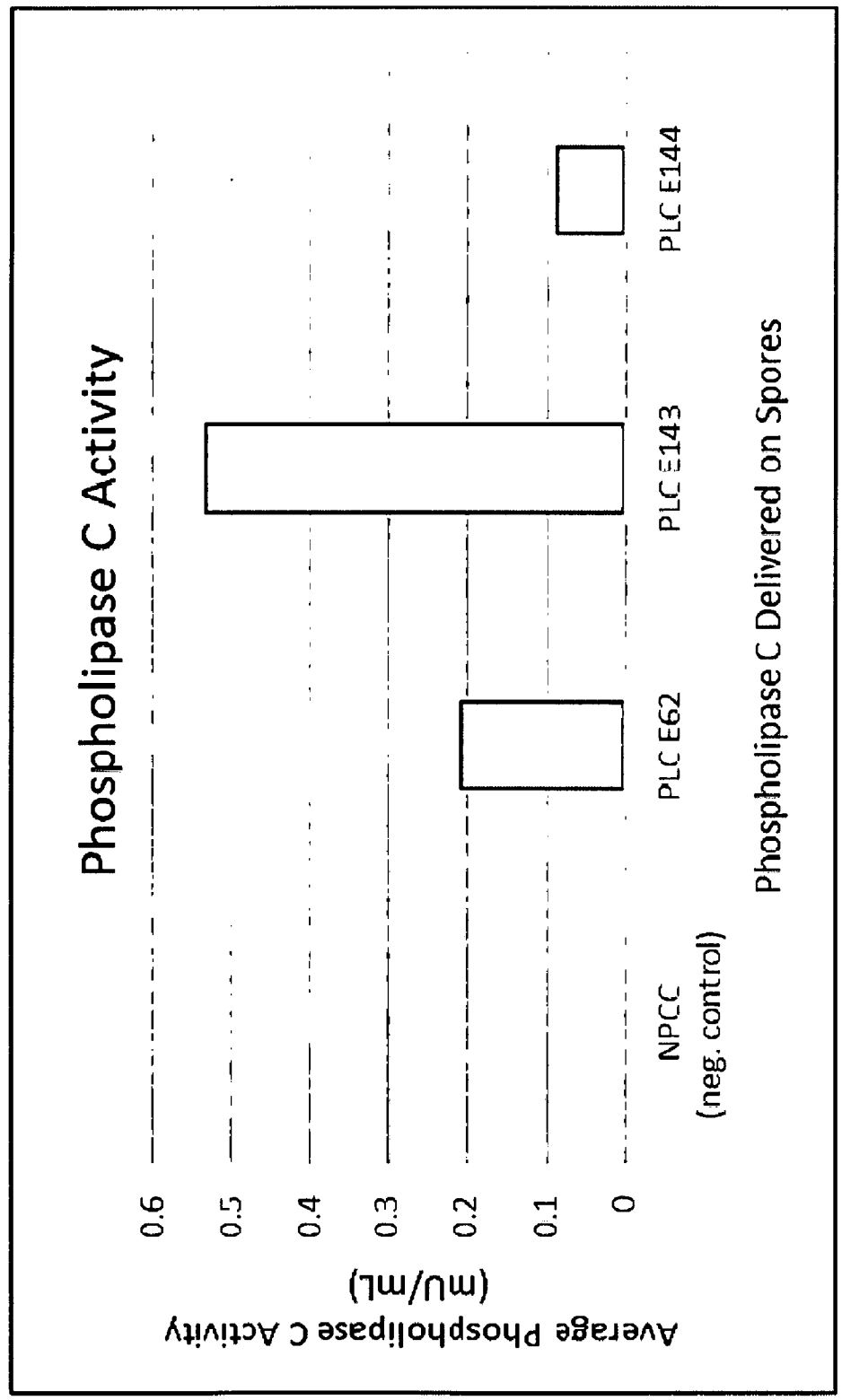
Figure 13:
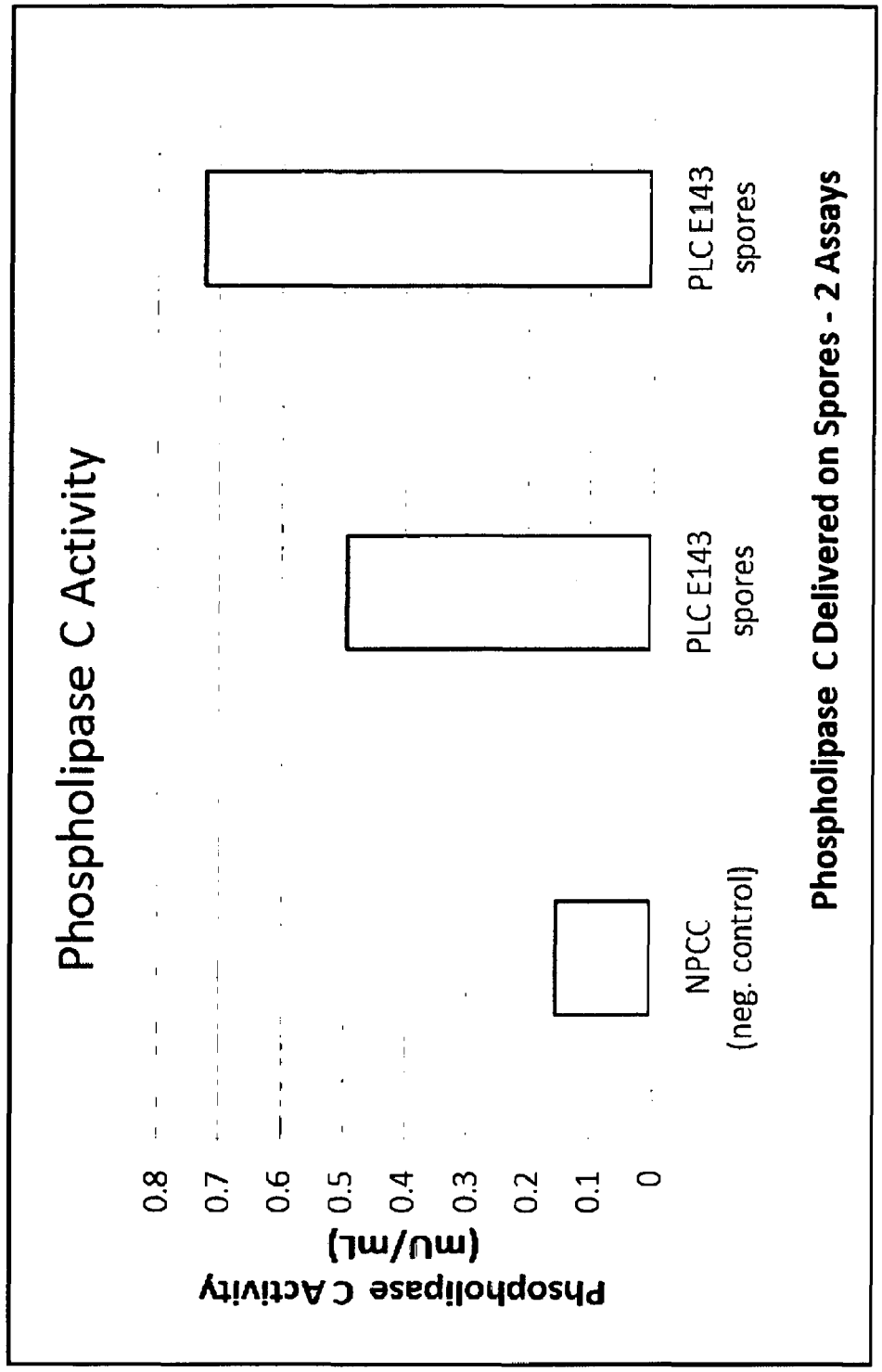

Spores expressing each of the PLC constructs were then incubated with 2.8 μmol of the NPPC substrate in 100 mM HEPES, pH 7.0 for 180 minutes at 37° C. Each spore preparation contained approximately $2 \times 10^8$ spores. The NPPC substrate alone was used as a negative control. The reaction was then stopped by adding 2004, of 0.1 M sodium bicarbonate. The absorption of each sample at 405 nm was then measured using a spectrophotometer. Results are shown in FIGS. 12 and 13. FIG. 12 shows the activity of the E62, E143 and E144 enzyme constructs as compared to the NPPC-alone negative control. FIG. 13 shows the activity of the E143 enzyme construct as measured in two different assays, as compared to the NPPC-alone negative control.

Example 43: Seed Treatment of Soybean with Phospholipase C

The PLC constructs described in Example 42 above were also evaluated for their effects on soybean when applied as a seed treatment. Soybean seeds (Beck's soybean hybrid 297NR) were treated as described above in Example 35, except that a 0.5 μl volume of each of the E62, E143, and E144 spore preparations was used. The spore preparations contained $1.8-1.9 \times 10^8$ spores per mL (from cultures that resulted in approximately 99% sporulation). Control seeds were treated with non-transformed Bacillus spores with no enzymes (E0) or with water alone. Seeds were planted and plants were grown in an environmentally controlled growth room. Seeds was planted directly into 39.7 cm³ pots containing Timberline #13 top soil combined with MIRACLE-GRO potting soil at a ratio of 1:4 and planted at a depth of 2.54 cm, with 2 seeds per pot. After planting, 50 mL of room temperature water was added to each pot to allow for germination. The pots were kept in an artificial lighted growth room receiving approximately 300 μmol $m^{-2} s^{-1}$ (light photons) for a 12/12 light/day cycle and a 21° C. day/15° C. night temperature range. Plants received the same watering and fertilizer regimes.

Plant height was measured at 4-5 weeks. Soybean growth from seeds that received the phospholipase C (E62, E143, E144) was compared with growth from seeds treated with Bacillus spores alone (E0). Results are summarized in Table 70 as the average plant height normalized to control plants grown from seeds treated with water alone. All treatments including the spore without enzyme (E0) treatment are reported as normalized to plants that received the water-control alone seed treatment. Soybean plants grown from seeds treated with the phospholipase C enzymes (E62, E143, E144) or with Bacillus spores alone had substantial increases in plant height compared to control plants grown from the water treated seeds. The phospholipase C E143 treatment had the greatest effect, showing a +88% increase in plant height over the water-only control (Table 70).

TABLE 70

Effects of seed treatment with PLC on plant height in soybean

| Seed Treatment, Soybean | Percentage average plant height (cm) normalized to control |
|---|---|
| Bacillus Spores (EO no enzyme) | 126.2% |
| Phospholipase C E62 | 131.8% |

TABLE 70-continued

Effects of seed treatment with PLC on plant height in soybean

| Seed Treatment, Soybean | Percentage average plant height (cm) normalized to control |
|---|---|
| Phospholipase C E143 | 187.6% |
| Phospholipase C E144 | 160.6% |

Example 44: Phospholipase D Treatment of Corn and Soybean

A construct encoding a fusion protein containing a phospholipase D (PLD) enzyme was prepared as described above in Example 26. The construct contained the BclA promoter (SEQ ID NO: 149), a start codon, a coding sequence for amino acids 20-35 of BclA (amino acids 20-35 of SEQ ID NO: 1), and a coding sequence for a PLD (SEQ ID NO: 256; ID CODE: D409). The construct was cloned into the tetracycline-resistance conferring pBCm-BclA20-35 plasmid described above in Example 30. This plasmid was then transformed into wild-type Bacillus thuringiensis BT013A and spores were generated as described above in Example 26.

Corn seeds (hybrid 5828 YH) and soybean seeds (hybrid MorSoyXtra 38X52) were treated as described above in Examples 30 and 35 using a 1 μL (1× standard application) or 2 μL (2× standard application) of the spore preparation. As in preceding examples, the spore preparations contained $1.8\text{-}1.9\times10^8$ spores/mL (from cultures that result in approximately 99% sporulation). Seeds were treated as described in Examples 27 and 35. Seeds were planted and grown as previously described in Example 27 (for corn) or Example 35 (for soybean) and growth measurements (plant height, dry biomass, nodulation) were taken at 2 weeks (for corn) or at 4-5 weeks (soybean). Two or three replicate trials were conducted using on average 18 plants per trial and results are summarized on Tables 71-74. Results were normalized to water treated controls.

TABLE 71

Effects of seed treatment with PLD on plant height in corn

| Corn Seed Treatment | Percentage average plant height (cm), normalized to control (average of two trials) |
|---|---|
| Phospholipase D409 (1 μL) | 103% |
| Phospholipase D409 (2 μL) | 99% |

Phospholipase D409 applied at a 1× use rate to corn seed provided an increase in for corn growth as measured by a +3% increase in plant height over control plants grown from water-treated seeds (Table 71).

TABLE 72

Effects of seed treatment with PLD on fresh weight in soybean (average of two trials)

| Seed Treatment Soybean | Percentage average total fresh weight (g) normalized to control | Percentage average root fresh weight (g) normalized to control | Percentage average above ground fresh weight (g) normalized to control |
|---|---|---|---|
| Phospholipase D D409 1X (1 µL/seed) | 101% | 94% | 109% |
| Phospholipase D D409 2X (2 µL/seed) | 108% | 101% | 117% |

Phospholipase D409 applied at the higher 2× use rate (2 µL/seed) to soybean seeds resulted in an incremental increase in total fresh weight, root fresh weight, and above ground fresh weight as compared to the seed treated with the water control. The greatest effects were seen with above ground fresh weight (a 17% increase over control) (Table 72).

TABLE 73

Effects of seed treatment with PLD on plant height in soybean

| Seed Treatment Soybean | Percentage average plant height (cm), normalized to control (average of three trials) |
|---|---|
| Phospholipase D409, 1X (1 µL/seed) | 116% |
| Phospholipase D409, 2X (2 µL/seed) | 117% |

Phospholipase D (D409) applied to soybean seed at the 1× and 2× use rates resulted in similar overall increases in plant height (+16% or +17%, respectively) as compared to the seed treated with the water control. Data shown is an average of three trials (Table 73).

TABLE 74

Effects of seed treatment with PLD on early nodulation in soybean

| Seed Treatment Soybean, Early Nodulation | Percentage average nodules per plant, normalized to control |
|---|---|
| Phospholipase D409, 1X (1 µL per seed) | 123% |
| Phospholipase D409, 2X (2 µL per seed) | 118% |

Changes in early nodulation as measured by average nodules per soybean plant were compared using seed treatments with phospholipase D (D409) at a 1× (1 µL/seed) and a 2× (2 µL/seed) use rates. Nodules were counted on 12 separate plants per trial at 4-5 weeks. Plants grown from seeds treated with phospholipase D (D409) at either use rate showed an increase in nodules per plant compared to control. On average, the 1× and 2× use rates resulted in a +23% and +18% increase in nodulation, respectively, over control plants (Table 74).

Example 45: Seed Treatment of Soybean and Corn with Multiple Enzyme Classes

Spore preparations as described in the above examples containing the enzymes described below were applied to soybean (hybrid MorSoyXtra 38X52) (Tables 75-77) or corn (Beck's corn hybrids 5828 YH) (Tables 78-80). Spores were treated with 1 µL of the spore preparations. All seeds were treated as described in Example 30 (for corn) or 35 (for soybean). All plants were grown as described in Example 27 (for corn) or 35 (for soybean). Corn plant height was measured at two weeks (Tables 78-80). Growth measurements (biomass, height, nodulation) were taken at 4-5 weeks for soybean (Tables 75-77). All measurements are reported in Tables 75-80 as averages or as normalized to control plants grown from water treated seeds. Two or three replicate trials were conducted using on average 18 plants per trial.

TABLE 75

Effects of seed treatment with various enzymes on nodulation in soybean

| Seed Treatment Soybean | Average Number of Nodules per plant (STDEV) | Percentage change in nodules as normalized to control |
|---|---|---|
| Control (Water) | 9.8 (4.1) | — |
| β-1,4-endoglucanase E94 | 10.8 (5.13) | +10% |
| Xylosidase E175 | 9.9 (3.83) | +1% |
| Xylosidase E194 | 8.6 (5.98) | −12% |
| Mannanase E177 | 10.6 (5.58) | +8% |
| Mannanase E196 | 10.4 (3.52) | +6% |
| Endopolygalacturonase D405 | 9.8 (4.56) | — |

Table 75 summarizes the average number of nodules per plant recorded at 4-5 weeks in soybean plants grown from seeds treated with β-1,4-endoglucanase E94, xylosidase E175, xylosidase E194, mannanase E177, mannanase E196, or endopolygalacturonase D405. The table averages data taken from 3 separate trials with 16 replicate plants per trial, a total of 48 plants. Seed treatment using β-1,4-endoglucanase (E94) and mannanase enzymes (E177 and E196) increased nodule count per plant by +10%, +8% and +6%, respectively, as compared to control plants grown from water-treated seeds.

TABLE 76

Effects of seed treatment with various enzymes on dry weight biomass in soybean

| Seed Treatment Soybean | Average Plant Dry Weight Total (grams) per plant | Average Above Ground Dry Weight (grams) per plant | Average Root Dry Weight (grams) per plant | Ratio of Above Ground Dry Weight to Root Dry Weight |
|---|---|---|---|---|
| Control (Water) | 2.8 | 2.0 | 0.8 | 2.5 |
| β-1,4-endoglucanase E94 | 4.0 | 3.4 | 0.6 | 5.6 |
| Xylosidase E175 | 3.6 | 2.8 | 0.8 | 3.5 |
| Xylosidase E194 | 2.5 | 1.9 | 0.6 | 3.2 |
| Mannanase E177 | 3.6 | 2.8 | 0.8 | 3.5 |
| Mannanase E196 | 3.1 | 2.4 | 0.7 | 3.4 |
| Endopolygalacturonase D405 | 3.9 | 3.3 | 0.6 | 5.5 |

Table 76 summarizes the total dry weight, above ground dry weight, and root dry weight for soybean (hybrid MorSoyXtra 38X52) plants grown from seeds treated with β-1,4-endoglucanase E94, xylosidase E175, xylosidase E194, mannanase E177, mannanase E196 or endopolygalacturonase D405. The data in Table 76 are averages of data recorded from 2 separate trials with 16 replicate plants per trial, a total of 32 plants. All of the enzymes tested showed improvements in the above ground biomass (weight) compared to control plants. In addition, the ratio of above ground dry weight to root dry weight was determined to investigate changes in above ground biomass to root biomass in response to individual treatments. This ratio for the plants that received the water control seed treatment is equivalent to 2.5. All of the enzymes in Table 76 (E94, E175, E194, E196 and D405) resulted in an increased ratio of above ground dry weight to root dry weight compared to water-treated controls. The largest effects were seen with treatment with β-1,4-endoglucanase E94 and endopolygalacturonase D405, which showed ratios of 5.6 and 5.5 respectively, over two-fold higher than controls (2.5).

TABLE 77

Effects of seed treatment with various enzymes on total dry weight and overall above ground dry biomass in soybean

| Seed Treatment Soybean | Percentage Average Plant Dry Weight Total (grams) per plant | Percentage Average Above Ground Dry Weight (grams) per plant |
|---|---|---|
| Control (Water) | 100% | 100% |
| β-1,4-endoglucanase E94 | 168% | 198% |
| Xylosidase E175 | 132% | 145% |
| Xylosidase E194 | 110% | 116% |
| Mannanase E177 | 136% | 148% |
| Mannanase E196 | 124% | 136% |
| Endopolygalacturonase D405 | 151% | 178% |

Table 77 summarizes the total dry weight and above ground dry weight normalized to controls for soybean (hybrid MorSoyXtra 38X52) plants grown from seeds treated with β-1,4-endoglucanase E94, xylosidase E175, xylosidase E194, mannanase E177, mannanase E196, or endopolygalacturonase D405. Differences in the amount of total plant dry weight and above ground dry weight are reported for 2 trials with 18 replicate plants per trial. The greatest comparative increases across the classes of enzymes were observed for β-1,4-endoglucanase E94 and endopolygalacturonase D405. These results further support the ratio increases described above in Table 76.

TABLE 78

Effects of seed treatment with various enzymes on plant growth in corn

| Seed Treatment, Corn | Percentage average plant height (cm), normalized to control |
|---|---|
| β-1,4-endoglucanase E94 | 106% |
| Xylosidase E175 | 106% |
| Mannanase E177 | 126% |
| Mannanase E196 | 115% |

Table 78 summarizes average plant height recorded at two weeks for corn plants (Beck's hybrid 5828 YH) grown from seeds treated with β-1,4-endoglucanase E94, xylosidase E175, xylosidase E194, mannanase E177, mannanase E196. The data in the table are averages from 2 trials with 18 replicate plants per trial. Corn seed treatment with the mannanase enzymes E177 and E196 resulted in substantial increases in plant height, +26% and +15%, respectively, as compared to corn plants grown from the water-treated seeds.

TABLE 79

Seed treatment application of enzymes increases plant height for corn

| Seed Treatment, Corn | Percentage average plant height (cm) normalized to control |
|---|---|
| Xylosidase E175 | 106% |
| Mannanase E177 | 126% |
| Mannanase E196 | 115% |

Table 79 summarizes another study comparing plant height at two weeks for corn plants (Beck's hybrid 5828) grown from seeds treated with xylosidase E175 and mannanases E177 and E196. The table shows average plant height normalized to water treated controls from 3 trials with 18 replicate plants per trial. Corn seed treatment for all the enzymes tested resulted in increased plant height compared to control. Seed treatments with the mannanase class of enzymes E177 and E196 showed the largest effects, with respective increases of +26% and +15% in plant height as compared to control plants grown from water treated seed.

Example 46: Yield Experiments

The effect of seed treatment, foliar application, or in-furrow treatment on corn and soybean yield in the field will be tested. Field seed beds at a variety of US Midwest locations will be prepared using conventional or conservation tillage methods for corn and soybean plantings. Fertilizer will be applied as recommended by conventional farming practices and will remain consistent between the US Midwest locations. Herbicides will be applied for weed control and supplemented with cultivation when necessary.

Corn and soybean hybrids will be treated as seeds, in-furrow, or via foliar spray with spore preparations prepared as described in the above Examples and containing a phospholipase, a β-1,4-endoglucanase, an ACC deaminase, a lichenase, a xyloglucanase, a xylanase, a xylosidase, a mannanase, or a pectin-degrading enzyme.

Seed treatment will be conducted with a WINTERSTEIGER HEGE 11 (Wintersteiger AG, Austria). The capacity of this seed treatment machinery can accommodate a large number of different seed types, sizes and amounts of seed (20-3000 grams). The seeds will be loaded into bowls of the seed treater machinery. The bowl selection depends on the treatment seed amount required and the size of the bowl selected: large 14.5 L bowl (500-3000 g seed per coating); medium 7 L bowl (80-800 g seed per coating); and small 1 L bowl (20-100 g seed per coating). During operation, the seeds will be distributed toward the radial peripheries of the rotatable bowls via an application of centrifugal force with the centrifugal coating device. The spinning disc located at the bottom of the bowl will distribute the seed treatment evenly over the seed. At this point, the spin cycle will start, which will cause the seeds to revolve around the bowl center in a circle to evenly coat the seeds. The process of seed providing a seed treatment, coating or dressing will be initiated after the seed is evenly dispersed around the spreader. Seed treatment sample material (such as a powdered, semi-liquid, liquid or a slurry) may be applied onto the rotatable disk as the disks are spinning within the rotatable bowls used to distribute the seed treatment evenly to provide a uniform coat and dress the surface of the seed.

An equivalent amount of each spore preparation of approximately 1 μL (standard application) will be applied per each seed. A constant air flow will be delivered using compressed air (2-6 bars) during seed coating to assist with uniformly coating the seeds in the bowl. The amount of time for the coating of the seed will depends on the amount of the seed, the viscosity of the seed treatment and the type of the seed used in the treatment. A seed treatment calculator will be used to adjust for all volumes, for most major and commercially grown crops, and the type of seed treatment being applied. After the seed has been treated and dried, the seeds will be distributed into a larger storage container(s). Seeds will be either air dried or dried with a continuous air stream that passes over the seeds. Seeds will then be transferred into a separate container or bag for shipment, transfer or storage.

After treatment, corn and soybean seeds will be planted in properly prepared fields. Corn seed will be planted 4-5 cm deep to assure normal root development. Corn seed will be planted at 28,000 to 32,000 plants per acre with row widths of 30 inch rows with seed spacing of approximately 1.6 to 1.8 seeds per foot. Soybean seeds will be planted 1.5 to 2 inches deep to assure normal root development. Soybean seed will be planted at approximately on average 140,000 plants per acre with row widths of 30 inch (76.2 cm) rows with seed spacing of approximately 7 to 8 seeds per foot (per 30.5 cm). Two-row plots, 25 feet (7.62 m) long will be planted at all (10-20) locations. Each hybrid will be grown in at least three separate plots (replicates) at each location to account for field variability.

Parallel experiments will treat plants with foliar application or in-furrow treatment using the same spore preparations. The yield (Bu/Ac) of each crop treated with the growth promoting enzymes delivered as seed treatments, foliar or in-furrow treatments will be reported on a per location and across location basis. Yield will be reported as normalized to the non-treated control plants and show as an increase or a decrease in Bu/Ac compared to the control plants that did not receive treatment with an enzyme.

Example 47: Use of Various Targeting Sequences to Express Endoglucanase on the Surface of *Bacillus cereus* Family Member Spores The pSUPER plasmid was generated through fusion of the pUC57 plasmid (containing an ampicillin resistance cassette and a ColE1 origin of replication) with the pBC16-1 plasmid from *Bacillus cereus* (containing a tetracycline resistance gene, repU replication gene and oriU origin of replication). This 5.8 kb plasmid can replicate in both *E. coli* and *Bacillus* spp. and can be selected by conferring resistance to β-lactam antibiotics in *E. coli* and resistance to tetracycline in *Bacillus* spp. The pSUPER plasmid was modified by insertion of a PCR-generated fragment that fused the BclA promoter (SEQ ID NO: 149), a start codon, amino acids 20-35 of BclA (amino acids 20-35 of SEQ ID NO: 1) and a polyalanine linker sequence (AAAAADLE; SEQ ID NO: 386) in frame with *Bacillus subtilis* 168 β-1,4-endoglucanase (the signal peptide of SEQ ID NO: 334, directly linked to the β-1,4-endoglucanase of SEQ ID NO: 293) resulting in a plasmid termed pSUPER-BclA 20-35-Endo. For replacement of the targeting sequence the pSUPER-BclA 20-35-Endo plasmid was subjected to inverse PCR to amplify the entire plasmid backbone, but leaving out the sequence corresponding to amino acids 20-35 of BclA. This inverse PCR product was combined with a PCR product containing the equivalent region from each of SEQ ID NOs: 5, 15, 25, 81, 85, 87, or amino acids 20-33 of SEQ ID NO: 1. Thus, constructs were created that contained each of the following targeting sequences fused in frame with *Bacillus subtilis* 168 endoglucanase: (1) amino acids 20-35 of SEQ ID NO: 1; (2) SEQ ID NO: 381; (3) SEQ ID NO: 383; or (4) SEQ ID NO: 382. Each of these constructs was transformed into *E. coli* and plated on Lysogeny broth petri plates plus ampicillin (100 μg/ml) to obtain single colonies. Individual colonies were used to inoculate Lysogeny broth plus ampicillin and incubated overnight at 37° C., 300 rpm. Plasmids from resulting cultures were extracted using the Wizard Plus SV Minipreps DNA Purification System (Promega Corporation). DNA concentrations of these plasmid extracts were determined via spectrophotometry and obtained plasmids subjected to analytical digests with appropriate combinations of restriction enzymes and then visualized by agarose gel electrophoresis to investigate plasmid size and presence of distinct plasmid features. Relevant sections, such as the 3-1,4-endoglucanase expression cassette, of the purified pSUPER derivatives were further investigated by Sanger sequencing. Verified pSUPER plasmids were introduced by electroporation into *Bacillus thuringiensis* BT013A or a BT013A derivative in which the native bclA gene (BclA knockout, "BclA KO") had been removed from the genome through homologous recombination. Single transformed colonies were isolated by plating on nutrient broth petri plates containing tetracycline (10 µg/ml). Individual positive colonies were used to inoculate brain heart infusion broth containing tetracycline (10 µg/ml) and incubated overnight at 30° C., 300 rpm. Genomic DNA of resulting cultures was purified and sections of the pSUPER plasmid were re-sequenced to verify genetic purity of the closed sequences. Verified colonies were grown overnight in brain heart infusion broth with 10 µg/ml tetracycline and induced to sporulate through incubation in a minimal yeast extract-based media.

Example 48: Use of a Tetracycline-Based Expression Cassette to Express Enzymes (e.g. Xylanases) on the Surface of Bacillus cereus Family Member Spores The pSUPER-BclA 20-35-Endo plasmid was subjected to inverse PCR to amplify the entire plasmid backbone, but leaving out the sequences corresponding to the signal peptide and the β-1,4-endoglucanase open reading frame. This inverse PCR product was combined with a PCR product containing a nucleotide sequence encoding for one of the following xylanases SEQ ID NO: 268, SEQ ID NO: 273 (E232), or a fusion of the signal peptide of SEQ ID NO: 328 directly linked to the xylanase of SEQ ID NO: 268 (E100). Thus, constructs were created that contained open reading frames for the following amino acid sequences fused in frame with a start codon, amino acids 20-35 of BclA (SEQ ID NO: 1), a polyalanine linker (AAAAADLE; SEQ ID NO: 386) sequence and (1) SEQ ID NO: 268 (pSUPER-BclA 20-35-XynA_nosec); (2) SEQ ID NO: 273 (pSUPER-BclA 20-35-XynC); or (3) SEQ ID NO: 328 directly linked to SEQ ID NO: 268 (pSUPER-BclA 20-35-XynA) under transcriptional control of the BclA promoter. These constructs were transformed into E. coli and plated on Lysogeny broth petri plates plus ampicillin (100 µg/ml) to obtain single colonies. Individual colonies were used to inoculate Lysogeny broth plus ampicillin and incubated overnight at 37° C., 300 rpm. Plasmids from resulting cultures were extracted using the Wizard Plus SV Minipreps DNA Purification System (Promega Corporation). DNA concentrations of these plasmid extracts were determined via spectrophotometry. The plasmids were then subjected to analytical digests with appropriate combinations of restriction enzymes and visualized by agarose gel electrophoresis to investigate plasmid size and presence of distinct plasmid features. Relevant sections, such as the xylanase expression cassette, of the purified pSUPER derivatives were further verified by Sanger sequencing. pBC fragments (pBC16-1-derived section of pSUPER including BclA/xylanase expression cassette) of the created pSUPER plasmids were amplified by PCR and subsequently circularized by blunt-end ligation. Resulting pBC ligations were introduced by electroporation into Bacillus thuringiensis BT013A. Single transformed colonies were isolated by plating on nutrient broth petri plates containing tetracycline (10 µg/ml). Individual positive colonies were used to inoculate brain heart infusion broth containing tetracycline (10 µg/ml) and incubated overnight at 30° C., 300 rpm. Genomic DNA of resulting cultures was purified and the pBC plasmid re-sequenced to verify the genetic purity of the cloned sequences. Verified colonies were grown overnight in brain heart infusion broth with 10 µg/ml tetracycline and induced to sporulate through incubation in a minimal yeast extract-based media.

Example 49: Use of an Expression Cassette Comprising a Non-Antibiotic Selectable Marker to Express Phospholipase C (PLC) on the Surface of Bacillus cereus Family Member Spores The pSUPER-BclA 20-35-Endo plasmid (see above) was subjected to inverse PCR to amplify the entire plasmid backbone, but leaving out the sequence for the tetracycline resistance gene. This inverse PCR product was combined with a PCR product containing a non-antibiotic selectable marker expression cassette. The resulting plasmid was subjected to another inverse PCR adjusted to amplify the entire plasmid backbone, but leaving out the sequences corresponding to the signal peptide and the β-1,4-endoglucanase open reading frame. This inverse PCR product was combined with a PCR product containing a nucleotide sequence encoding for a fusion of SEQ ID NO: 317 and SEQ ID NO: 250 (designated as ID CODE: E80 when expressed with the non-antibiotic selectable marker system). Thus, a construct was created that contained a start codon, amino acids 20-35 of BclA (SEQ ID NO: 1), an alanine linker (AAAAAALE (SEQ ID NO: 387) as described in Table 80 below) sequence fused in frame with Bacillus thuringiensis phospholipase C (the signal peptide of SEQ ID NO: 317, directly linked to the phospholipase C of SEQ ID NO: 250) under transcriptional control of the BclA promoter. This construct was transformed into E. coli and plated on Lysogeny broth petri plates plus ampicillin (100 µg/ml) to obtain single colonies. Individual colonies were used to inoculate Lysogeny broth plus ampicillin and incubated overnight at 37° C., 300 rpm. Plasmids from resulting cultures were extracted using the Wizard Plus SV Minipreps DNA Purification System (Promega Corporation). DNA concentrations of these plasmid extracts were determined via spectrophotometry. The plasmids were then subjected to analytical digests with appropriate combinations of restriction enzymes and visualized by agarose gel electrophoresis to investigate plasmid size and presence of distinct plasmid features. Relevant sections, such as the phospholipase expression cassette, of the purified pSUPER derivatives were further verified by Sanger sequencing. The pBC fragment (pBC16-1-derived section of pSUPER including BclA/phospholipase expression cassette) of the created pSUPER plasmid was amplified by PCR and subsequently circularized by blunt-end ligation. The resulting pBC ligation was introduced using electroporation into a Bacillus thuringiensis BT013A derivative strain that had been modified to support the use of the non-antibiotic selectable marker. Single colonies of transformations were obtained by plating on minimal broth petri plates. Individual colonies were used to inoculate a minimal broth and incubated overnight at 30° C., 300 rpm. Genomic DNA of resulting cultures was purified and the pBC plasmid re-sequenced to verify genetic purity. Verified colonies were grown overnight in a minimal media and induced to sporulate through incubation in a minimal yeast extract-based media.

The activity level of the recombinant Bacillus cereus family members expressing fusion proteins containing endoglucanases produced in Example 47, the E100 xylanase produced in Example 48, or the E80 phospholipase C produced in the present example (Example 49) were measured and compared to the activity level of recombinant Bacillus cereus family members expressing fusion proteins containing lichenases; mannanases; xyloglucanases; the E143, D473, D474, D475, and E258 phospholipase C enzymes; phospholipase D enzymes; xylosidases; pectolyases; acid phosphatase; phytase; and lactonase, (all prepared using the same expression system as described in Example 48 and the linker sequences listed in Table 80 below); and an ACC deaminase prepared as exosporium fragments as described in Example 26 and using the linker sequence listed in Table 80 below. The activity assays for each of these enzyme types have been described in examples hereinabove (e.g., Example 29) except for those to measure phospholipase, xylanase, lichenase, xylosidase, pectic enzymes, phytase, lactonase, or ACC deaminase activity which are described below.

Phospholipase

Phospholipase C (PLC) activity was assayed by quantifying p-nitrophenol release using p-nitrophenylphosphorylcholine (NPPC; CAS #21064-69-7, Carbosynth EN26341) as a substrate. Aliquots (1 mL) of spore productions were centrifuged 5 min at 16,100×g in a tabletop microcentrifuge to pellet spores. Spore pellets were resuspended in 30 deionized water and transferred to a 300 µL/well 96-well PCR plate. Thirty microliters of reaction buffer (20 mM NPPC, 200 mM HEPES, pH 7.0, 60% w/v D-sorbitol) were added to each well and reactions were incubated at 37° C. in a PCR thermocycler for 45 min. Subsequently, 60 µL 0.5 M sodium bicarbonate buffer containing 25 mM EDTA was added to stop reactions and develop color. The PCR plate was centrifuged 5 min. at 2,272×g in a plate centrifuge to pellet spores. Supernatants were transferred to a flat bottom 350 µL/well 96-well microplate and absorbance at 405 nm was measured using a Synergy HTX (BioTek) microplate reader. PLC activity was quantified by comparison to a p-nitrophenol (CAS #100-02-7, Acros Organics 157050050) standard curve under consideration of incubation time. Samples were assayed in triplicate.

Xylanase

Xylanase activity was quantified by a reducing sugar assay using 4-O-methyl-D-glucurono-D-xylan (MGX; CAS #9062-57-1, Sigma M5144) as a substrate. Aliquots (0.5-1 mL) of spore productions were centrifuged 5 min at 16,100×g in a tabletop microcentrifuge to pellet spores. Spore pellets were resuspended in 60 µL 50 mM citrate buffer, pH 5.0 and transferred to a 300 µL/well 96-well PCR plate. Eighty microliters of 0.5% w/v MGX (in water) were added to each well and reactions were incubated at 50° C. in a PCR thermocycler for 40 min. The plate was placed on ice and 120 µL DNS reagent (1% w/v 3,5-dintrosalicylic acid, 1% NaOH, 0.05% $Na_2SO_4$, 0.2% phenol, 18.2% Rochelle salt) was added. Reactions were subsequently incubated at 100° C. for 10 min. in a PCR thermocycler. The PCR plate was centrifuged 5 min. at 2,272×g in a plate centrifuge to pellet spores. Supernatants were transferred to a flat bottom 350 µL/well 96-well microplate and absorbance at 540 nm was measured using a Synergy HTX (BioTek) microplate reader. Xylanase activity was quantified by comparison to a glucose standard curve under consideration of incubation time. Samples were assayed in triplicate.

Lichenase

Lichenase activity was quantified by a reducing sugar assay using β-D-glucan from barley (CAS #9041-22-9, Sigma G6513) as a substrate. Aliquots (1 mL) of spore productions were centrifuged 5 min. at 16,100×g in a tabletop microcentrifuge to pellet spores. Spore pellets were resuspended in 60 µL 50 mM HEPES buffer, pH 7.0 and transferred to a 300 µL/well 96-well PCR plate. Eighty microliters of 0.5% w/v β-D-glucan (in water) were added to each well and reactions were incubated at 50° C. in a PCR thermocycler for 25 min. The plate was placed on ice and 120 µL DNS reagent (1% w/v 3,5-dintrosalicylic acid, 1% NaOH, 0.05% $Na_2SO_4$, 0.2% phenol, 18.2% Rochelle salt) was added. Reactions were subsequently incubated at 100° C. for 10 min in a PCR thermocycler. The PCR plate was centrifuged 5 min at 2,272×g in a plate centrifuge to pellet spores. Supernatants were transferred to a flat bottom 350 µL/well 96-well microplate and absorbance at 540 nm was measured using a Synergy HTX (BioTek) microplate reader. Lichenase activity was quantified by comparison to a glucose standard curve under consideration of incubation time. Samples were assayed in triplicate.

Xylosidase

Xylosidase activity was assayed by quantifying p-nitrophenol release using p-nitrophenyl-β-D-xylopyranoside (PNPX; CAS #2001-96-9, Sigma N2132) as a substrate. Aliquots (50-200 µL) of spore productions were centrifuged 5 min at 16,100×g in a tabletop microcentrifuge to pellet spores. Spore pellets were resuspended in 50 µL 100 mM citrate buffer, pH 6.2 and transferred to a 300 µL/well 96-well PCR plate. Fifty microliters of 5 mM PNPX (in water) were added to each well and reactions were incubated at 37° C. in a PCR thermocycler for 20 min. Enzymatic activity was stopped by addition of 100 µL 95% ethanol. Subsequently, 50 µL 0.5 M sodium bicarbonate was added for color development. The PCR plate was centrifuged 5 min at 2,272×g in a plate centrifuge to pellet spores. Supernatants were transferred to a flat bottom 350 µL/well 96-well microplate and absorbance at 405 nm was measured using a Synergy HTX (BioTek) microplate reader. Xylosidase activity was determined by comparison to a p-nitrophenol (CAS #100-02-7, Acros Organics 157050050) standard curve under consideration of incubation time. Samples were assayed in triplicate.

Pectic Enzymes

Pectolyase/polygalacturonase activity was quantified by a reducing sugar assay using pectin from citrus peel (CAS #9000-69-5, Sigma P9135) as a substrate. Aliquots (0.5-1 mL) of spore productions were centrifuged 5 min at 16,100×g in a tabletop microcentrifuge to pellet spores. Spore pellets were resuspended in 70 µL 50 mM CHES buffer, pH 10.0 and transferred to a 300 µL/well 96-well PCR plate. Thirty microliters of deionized water and 40 µL 1% w/v pectin (in water) were added to each well and reactions were incubated at 50° C. in a PCR thermocycler for 45 min. The plate was placed on ice and 120 µL DNS reagent (1% w/v 3,5-dintrosalicylic acid, 1% NaOH, 0.05% $Na_2SO_4$, 0.2% phenol, 18.2% Rochelle salt) was added. Reactions were subsequently incubated at 75° C. for 10 min. in a PCR thermocycler. The PCR plate was centrifuged 5 min at 2,272×g in a plate centrifuge to pellet spores. Supernatants were transferred to a flat bottom 350 µL/well 96-well microplate and absorbance at 540 nm was measured using a Synergy HTX (BioTek) microplate reader. Pectolyase/polygalacturonase activity was quantified by comparison to a glucose standard curve under consideration of incubation time. Samples were assayed in triplicate.

Phytase

Phytase activity was assayed by quantifying p-nitrophenol release using p-nitrophenyl phosphate (pNPP; CAS #4264-83-9, Sigma 487600-M) as a substrate. The reactions were prepared on ice in 1.7 mL tubes, each reaction contained 100 µL of whole spore productions, 100 µL 200 mM Na-Acetate buffer (pH 5), and 30 µL 30 mM pNPP (in water). Then, the reactions were incubated at 37° C. with agitation (800 rpm) for 30 min. Subsequently, reactions were place on ice and 100 µL 1 M NaOH were added to develop the yellow color that p-nitrophenol have at alkaline pH. Tubes were then centrifuged 5 min at 16,100×g in a tabletop microcentrifuge to pellet spores, and 200 µL supernatants were transferred to a flat bottom 350 μL/well 96-well microplate and absorbance at 400 nm was measured using a Synergy HTX (BioTek) microplate reader. Phytase activity was determined using the Beer-Lambert law and extinction coefficient at 400 nm of 18000 $M^{-1}$ $cm^{-1}$. Samples were assayed at least in duplicate.

Lactonase

Lactonase activity was measured using a pigmentation bioassay using *Chromobacterium violaceum* strain CV026, a mutant that only produces the purple pigment violacein in response to exogenous homoserine lactone (HSL). HSL was reacted with lactonase enzyme samples (H51), along with BT013A E0 (background strain with no enzyme) control treatment for 2 hours at 37° C. The samples were frozen at −80° C. to stop the reaction. LB-kanamycin agar petri plates were inoculated evenly with a culture of CV026 that had been grown in LB-kanamycin liquid culture overnight. A volume of 300 μL of the liquid culture containing the enzyme production and BT013A control was spread over the reaction petri plates. Once the media had dried on petri plates, a 1 μL volume of the thawed reaction products was applied to pre-marked spots on the petri plates. Treatments were applied in triplicate. Following overnight incubation at 30° C., images were taken of the petri plates, and the area of purple pigmentation produced by CV026 was quantified using ImageJ Software (National Institute of Health). A reduction in pigmentation indicated that the HSL in a given reaction had been degraded.

ACC Deaminase

ACC deaminase activity was assayed by measuring the amount of NADH (CAS #606-68-8, Sigma N8129) used by lactate dehydrogenase (EC number 1.1.1.27, Sigma 10127230001) when using a-ketobutyrate, made by ACC deaminase after a reaction with ACC (CAS #22059-21-8, Sigma 149101-M), as a substrate. 0.9-1 mL aliquots of spore productions were centrifuged for 5 minutes at 14,000 rpm in a tabletop microcentrifuge to pellet the spores. Spore pellets were resuspended in 1 mL of 100 mM TRIS buffer pH 8.0 then spun down again at 14,000 rpm for 5 minutes to pellet spores. The spore pellet was then resuspended in 600 μL 100 mM TRIS buffer pH 8.0, 10 mM ACC and 0.132 mM NADH and 200 μL was transferred to 3 wells in a 300 μL/well 96-well PCR plate. 5 U of lactate dehydrogenase was added to each well and the mixture was transferred to a flat bottom 350 μL/well 96-well microplate and allowed to react at 37° C. in a Synergy HTX (BioTek) microplate reader taking readings at 340 nm every 2 minutes for 1 hour. ACC deaminase activity was measured by subtracting background readings then using Beer-Lambert law and the NADH extinction coefficient. Samples were assayed in triplicate.

Table 80 lists the enzymatic activity measured from each production batch for these series of enzymes.

TABLE 80

Enzymes cloned and expressed using various expression plasmid backbones; tetracycline-based (pSUPER and pBC tetL) and non-antibiotic selectable marker (pBC NASM)

| Enzyme ID Code: SEQ ID NO: | Enzyme Nomenclature EC Number | Activity Measured from Production Batch (mU/mL) | Targeting sequence, exosporium protein, or exosporium protein fragment (Alanine linker) | Expression plasmid backbone/ strain |
|---|---|---|---|---|
| β-1,4-endoglucanase E94* *Bacillus subtilis* strain 168 (SEQ ID NO: 334 directly linked to SEQ ID NO: 293) | EC 3.2.1.4 | 499.49 mU/mL | BclA20-35 (amino acids 20-35 of SEQ ID NO: 1) (AAAAADLE; SEQ ID NO: 386) | pBC tetL/ BT103A |
| β-1,4-endoglucanase E107* *Bacillus subtilis* strain 168 (SEQ ID NO: 334 directly linked to SEQ ID NO: 293) | EC 3.2.1.4 | 260.09 mU/mL | BclA1-166 (SEQ ID NO: 383) (AAAAADLE; SEQ ID NO: 386) | pBC tetL/ BT103A |
| β-1,4-endoglucanase E108* *Bacillus subtilis* strain 168 (SEQ ID NO: 334 directly linked to SEQ ID NO: 293) | EC 3.2.1.4 | 84.01 mU/mL | BclA1-296 (SEQ ID NO: 382) (AAAAADLE; SEQ ID NO: 386) | pBC tetL/ BT103A |
| β-1,4-endoglucanase E110* *Bacillus subtilis* strain 168 (SEQ ID NO: 334 directly linked to SEQ ID NO: 293) | EC 3.2.1.4 | 98.05 mU/mL | CotY (SEQ ID NO: 381) (AAAAADLE; SEQ ID NO: 386) | pBC tetL/ BT103A |
| Xyloglucanase E149 *Bacillus licheniformis* (SEQ ID NO: 300) | EC 3.2.1.151 | 2.328 mU/mL | BclA20-35 (amino acids 20-35 of SEQ ID NO: 1) (AAAAADLE; SEQ ID NO: 386) | pBC tetL/ BT103A |

TABLE 80 -continued

Enzymes cloned and expressed using various expression plasmid backbones; tetracycline-based (pSUPER and pBC tetL) and non-antibiotic selectable marker (pBC NASM)

| Enzyme ID Code: SEQ ID NO: | Enzyme Nomenclature EC Number | Activity Measured from Production Batch (mU/mL) | Targeting sequence, exosporium protein, or exosporium protein fragment (Alanine linker) | Expression plasmid backbone/ strain |
|---|---|---|---|---|
| Xyloglucanase D381 *Paenibacillus pabuli* (SEQ ID NO: 299) | EC 3.2.1.151 | 245.387 mU/mL | BclA20-35 (amino acids 20-35 of SEQ ID NO: 1) (AAAAADL TABLE 80 -continued Enzymes cloned and expressed using various expression plasmid backbones; tetracycline-based (pSUPER and pBC tetL) and non-antibiotic selectable marker (pBC NASM)

| Enzyme ID Code: SEQ ID NO: | Enzyme Nomenclature EC Number | Activity Measured from Production Batch (mU/mL) | Targeting sequence, exosporium protein, or exosporium protein fragment (Alanine linker) | Expression plasmid backbone/ strain |
|---|---|---|---|---|
| Phospholipase D D409 Streptomyces chromofuscus (SEQ ID NO: 256) | EC 3.1.4.4 | Active | BclA20-35 (amino acids 20-35 of SEQ ID NO: 1) (AAAAADLE; SEQ ID NO: 386) | pBC TABLE 80 -continued Enzymes cloned and expressed using various expression plasmid backbones; tetracycline-based (pSUPER and pBC tetL) and non-antibiotic selectable marker (pBC NASM)

| Enzyme ID Code: SEQ ID NO: | Enzyme Nomenclature EC Number | Activity Measured from Production Batch (mU/mL) | Targeting sequence, exosporium protein, or exosporium protein fragment (Alanine linker) | Expression plasmid backbone/ strain |
|---|---|---|---|---|
| Phytase E246 *Bacillus subtilis* strain 168 (SEQ ID NO: 380) | EC 3.1.3.8 | 19 mU/mL | BclA20-35 (amino acids 20-35 of SEQ ID NO: 1) (AAAAADLE; SEQ ID NO: 386) | pBC tetL BT103A |
| Lactonase H51 *Bacillus thuringiensis* strain B184 (SEQ ID NO: 277) | EC 3.1.1.81 | Active | BclA20-35 (amino acids 20-35 of SEQ ID NO: 1) (AAAAADLE; SEQ ID NO: 386) | pBC tetL BT103A |
| ACC deaminase D406 (SEQ ID NO: 249) *Bacillus thuringiensis* | EC 3.5.99.7 | 0.92 mU/mL | BclA20-35 (amino acids 20-35 of SEQ ID NO: 1) (AAAAADLE; SEQ ID NO: 386) | pBC tetL BT013A ExsY knockout |
| Acid Phosphatase E252 *Bacillus thuringiensis* (SEQ ID NO: 378) | EC 3.1.3.2 | 0.75 mU/mL | BclA20-35 (amino acids 20-35 of SEQ ID NO: 1) (AAAAADLE; SEQ ID NO: 386) | pBC tetL BT103A |

*β-1,4-endoglucanases designated as E94, E107, E108 and E110 all contain the signal peptide of SEQ ID NO: 334 directly linked to the amino acid sequence of SEQ ID NO: 293 but differ with respect to the targeting sequence, exosporium protein, or exosporium protein fragment used to target the endoglucanase to the exosporium as follows: E94 contains BclA20-35 (amino acids 20-35 of SEQ ID NO: 1); E107 contains BclA1-166 (SEQ ID NO: 383); E108 contains full-length BclA1-296 (SEQ ID NO: 382); E110 contains CotY (SEQ ID NO: 381).

Example 50: Effects of Enzyme Treatments Provided as a Seed Treatment on Plant Growth Response in Corn Recombinant *Bacillus cereus* family members expressing fusion proteins containing a xyloglucanase, a mannanase, a xylanase, or a xylosidase were, prepared using the methods described above in Example 48 and were delivered as seed treatments onto corn seeds (Beck's corn hybrid 5828 YH) using the volumes (μL) applied to the outer coats of each seed as a seed treatment and indicated in Table 81-84. Each enzyme was prepared in whole cell broth which was collected and utilized in the experiments. A wild-type control (*B. thuringiensis* BT013A untransformed host strain (E0; no-enzyme control) was also applied to seed using a volume of 1 μL per seed and used as a control comparison for the enzyme treatments Corn seed that received the seed treatments with xyloglucanase, mannanase, xylanase, xylosidase and the E0 control treatments was then planted in 4×4 cm pots filled with Timberline 18 top soil with two seeds each planted per pot and initially watered with 50 mL of water to promote germination. Two replicates using 18 seeds per each treatment per replicate were placed in an environmentally controlled growth room and randomized using a complete randomized block design. Plants were grown under light levels of approximately 300 μmol $m^{-2}$ $s^{-1}$ and a 13 hour photoperiod (13/11 day/night cycle). Plants were maintained at 23.9° C. during the light hours and 18.3° C. during the dark hours. Plant height (an indicator of plant growth rate) was measured at 15 days after planting (DAP) or approximately at the V3 developmental growth stage to capture early plant vigor. An average plant height per each enzyme treatment was normalized to plants grown from seed that received and the E0 control provided to the seed using a 1 μL volume. Results of the xyloglucanase, mannanase, xylanase and xylosidase enzyme seed treatments on corn growth rate as indicated by changes in plant height are compared to the E0 (no enzyme) control shown in Table 81-84.

Xyloglucanases D381 and E149 applied as a seed treatment on corn resulted in an increased growth rates during early stages of corn development as indicated by an increased percentage averaged plant height normalized to plants grown from seed that received a water control treatment (Table 81). In general, plant height increased with increasing volumes of the xyloglucanase enzymes applied at 1 μL to 3 μL to the seed prior to planting. Seed treatments that received the 3 μL of the xyloglucanase enzymes (either D381 or E149) resulted in the greatest increases in plant height as normalized to the water control and compared to the E0 control which was generally comparable to the water control over the two replicates used in the trials. Seed treatment of corn using xyloglucanase D381 (SEQ ID NO: 299) applied using the 3 μL seed treatment volume per seed exhibited slightly greater increases in plant height at V3 (15 DAP) as compared to the xyloglucanase E149 (SEQ ID NO: 300), an 2.4% increase.

TABLE 81

Seed treatment with xyloglucanase, effect on plant height for corn*

| Seed Treatment Corn | Volume | Percentage Average Plant Height (cm) Normalized to Control Replicate 1 | Percentage Average Plant Height (cm) Normalized to Control Replicate 2 | Percentage Average Plant Height (cm) Normalized to Control Trial Average |
|---|---|---|---|---|
| E0 Control *B.* (*thuringiensis* BT013A) | 1 μL | 98.9% | 103.2% | 101.1% |
| Xyloglucanase D381 (SEQ ID NO: 299) | 1 μL | 102.2% | 101.9% | 102.1% |
|  | 2 μL | 104.2% | 105.0% | 104.6% |
|  | 3 μL | 104.6% | 110.9% | 107.8% |
| Xyloglucanase E149 (SEQ ID NO: 300) | 1 μL | 103.8% | 101.9% | 102.9% |
|  | 2 μL | 102.2% | 108.2% | 105.2% |
|  | 3 μL | 102.3% | 108.5% | 105.4% |

*Normalized to plants grown from seed that received the water control treatment (1 μL per seed).

Corn seed treatment using mannanases (E196 and E177) resulted in increased growth rates as indicated by an increase in plant height when compared to plants grown from seed that received the water control treatment or the BT013A E0 control (no enzyme) as shown in Table 82. Plants that were grown from seed treated with the E0 control did not show any substantial differences in plant height (cm) as compared to those grown from seed that received the water control for the two replicate treatments within the trial. Seed treatment with mannanase E196 (SEQ ID NO: 307) resulted in plants with increased plant height seen with the increasing dose of the enzyme from 1 μL to 3 μL with the 3 μL volume applied as a seed treatment yielded the greatest increase in height, a +7% increase over the control (grown from water-treated seed) plants. Mannanase E177 (SEQ ID NO: 308) applied as a seed treatment also resulted in corn plants with an increased growth rate or plant height as compared to the control plants (grown from water-treated seed). The greatest overall increases in plant height for plants were from seed treated with mannanase E177 (1 μL enzyme applied to the seed) an increase of +8% over the control plants.

TABLE 82

Seed treatment with mannanase, effect on plant height for corn*

| Seed Treatment Corn | Volume | Percentage Average Plant Height (cm) Normalized to Control Replicate 1 | Percentage Average Plant Height (cm) Normalized to Control Replicate 2 | Percentage Average Plant Height (cm) Normalized to Control Trial Average |
|---|---|---|---|---|
| E0 Control *B.* (*thuringiensis* BT013A) | 1 μL | 102.3% | 98.6% | 100.6% |
| Mannanase E196 (SEQ ID NO: 307) | 1 μL | 107.1% | 101.3% | 104.1% |
|  | 2 μL | 104.7% | 105.5% | 105.1% |
|  | 3 μL | 111.1% | 102.8% | 107.0% |
| Mannanase E177 (SEQ ID NO: 308) | 1 μL | 111.6% | 104.6% | 108.1% |
|  | 2 μL | 108.6% | 101.4% | 105.0% |
|  | 3 μL | 106.5% | 103.7% | 105.1% |

*Normalized to plants grown from seed that received a water control treatment (1 μL)

Seed treatments applied to corn seed using xylanase enzymes (E100, E146 and E232) also resulted in corn plants with increased plant height as compared or normalized to those plants grown from seed that the E0 control (1 μL) and assessed using two replicates of the same trial (Table 83). Generally, the enzyme volumes applied to the seed using either 1 μL or 2 μL resulted in similar increases in plant height. Seeds that received the xylanase E232 (SEQ ID NO: 273) resulted in the greatest increased plant height, +4% (1 μL) and +5% (2 μL) increase over or normalized to the plants grown from the E0 treated seed.

TABLE 83

Seed treatment with xylanase, effect on plant height for corn*

| Seed Treatment Corn | Volume | Percentage Average Plant Height (cm) Normalized to E0 Control Replicate 1 | Percentage Average Plant Height (cm) Normalized to E0 Control Replicate 2 | Percentage Average Plant Height (cm) Normalized to E0 Control Trial Average |
|---|---|---|---|---|
| E0 Control *B.* (*thuringiensis* BT013A) | 1 μL | 100.0% | 100.0% | 100.0% |

TABLE 83-continued

Seed treatment with xylanase, effect on plant height for corn*

| Seed Treatment Corn | Volume | Percentage Average Plant Height (cm) Normalized to Control Replicate 1 | Percentage Average Plant Height (cm) Normalized to E0 Control Replicate 2 | Percentage Average Plant Height (cm) Normalized to E0 Control Trial Average |
|---|---|---|---|---|
| Xylanase E100 (signal peptide of SEQ ID NO: 328 directly linked to SEQ ID NO: 268) | 1 μL | 99.3% | 104.7% | 102.0% |
|  | 2 μL | 96.8% | 108.2% | 102.5% |
| Xylanase E146 (SEQ ID NO: 268) | 1 μL | 101.4% | 105.3% | 103.4% |
|  | 2 μL | 101.9% | 102.7% | 102.3% |
| Xylanase E232 (SEQ ID NO: 273) | 1 μL | 104.0% | 104.3% | 104.2% |
|  | 2 μL | 105.2% | 104.8% | 105.0% |

*Normalized to plants grown from seed treated with the E0 control (1 μL)

In a separate experiment using xylosidase as a seed treatment on corn (Beck's corn hybrid 5828 YX), a similar approach was followed related to growth conditions and randomization of treatments within trials as previously described. In this experiment, corn seed that received the seed treatment with xylosidase and the corresponding E0 control treatment was then planted in 4×4 cm pots filled with a 2:1 Timberline 20 top soil to sand mixture to simulate early plant growth effects of corn grown in a sandy loam type soil. A three replicate trial using 18 plants per each treatment per replicate were grown under control environmental conditions as described above. Plant height (an indicator of plant growth rate) was measured at 15 days after planting (DAP) to capture early plant vigor. An average plant height (cm) was calculated per each enzyme treatment and normalized to a water control (provided using a 1 μL volume). Results of the xylosidase enzyme seed treatments and the E0 control on corn growth rates are represented as the average change in plant height compared to the water control averaged for the three replicates and shown in Table 84.

TABLE 84

Seed treatment with xylosidase, effect on plant height for corn

| Seed Treatment Corn | Volume | Percentage average plant height (cm) normalized to Control* |
|---|---|---|
| E0 Control (B. thuringiensis BT013A) | 1 μL | 101.9% |
| Xylosidase E194 (SEQ ID NO: 275) | 1 μL | 104.9% |
|  | 2 μL | 103.2% |
|  | 3 μL | 103.1% |
| Xylosidase E175 (SEQ ID NO: 276) | 1 μL | 103.3% |
|  | 2 μL | 102.5% |
|  | 3 μL | 106.1% |

*Average of 3 replicates; 18 seeds per replicate; Normalized to plants grown from seed treated with a water control (1 μL)

Seed treatments on corn using xylosidase (E194 and E175) enzymes applied using varying volumes of 1 μL to 3 μL resulted in positive growth benefits to V3 (15 DAP) corn plants. Seed treatment using xylosidase E194 did result in plants with increased heights compared to plants grown from seed that received the water or E0 control treatments, however changing the volume of the enzyme used as a seed treatment did not have an overall effect on the height increase at the V3 stage of development. Seed treatment using xylosidase E175 did however result in plants with increased height with the higher volume enzyme treatment of 3 μL and resulted in an +6% increase in plant height over the water control plants compared across the three replicates in the trial.

Example 51: In-Furrow Treatment, Effect on Growth in Corn

Recombinant *Bacillus cereus* family members expressing fusion proteins containing enzymes (xyloglucanase D381 (SEQ ID NO: 299)) and phospholipase C E143 (SEQ ID NO: 250) were prepared as described above in Examples 48 and Table 80 and were delivered as an in-furrow treatment to the area surrounding corn seeds (Beck's corn hybrid 5828 YH). Corn seed was planted in 4×4 cm pots filled with 2:1 Timberline 20 topsoil to sand with two seeds each planted per pot. Enzyme treatments as described in Tables 85-89 were applied using a 1× (3.5 μL enzyme in 1 mL water); 2× (7.0 μL enzyme in 2 mL water); or 3× (10.5 μL enzyme in 3 mL water) and compared to wild-type control (*B. thuringiensis* BT013A (E0; no enzyme) applied using a 1× treatment. Two to three replicates in an experimental trial as indicated were conducted for each in-furrow trial, with of 18 replicate plants per replicate. Seed was placed in an environmentally controlled growth room. The treatments were randomly assigned to location using a complete randomized block design. All treatments were applied to the soil area directly surrounding each seed after planting but prior to covering the seed with soil. Each pot was initially watered with 50 mL of water to promote germination. After germination, plants were watered using consistent regimes for all the in-furrow treatments. Plants were grown under light levels of approximately 300 μmol m$^{-2}$ s$^1$ (light photons) and a 13-hour photoperiod (13/11 day/night cycle). Plants were maintained at 23.9° C. during the light hours and 18.3° C. during the dark hours. Plant height (an indicator of plant growth rate) was measured at approximately 10 days after planting (DAP) or at the V2 stage of development to capture early plant vigor. An average plant height per each enzyme treatment was normalized to the plants grown from seed that received a 1× application treatment with water. Effects of the various enzyme in-furrow treatments on corn growth rate or plant height (cm) are shown for the individual enzymes and enzyme combinations in Tables 85-89.

Plant height differences for the in-furrow treatments using xyloglucanase enzymes (E149 and D381) and a phospholipase C (E143) enzyme are reported in Tables 85 and 86. Volumes of 1×, 2× and 3× application treatments of the production enzymes were applied to the soil area directly surrounding each seed. Plant growth measurements, plant height (cm) were compared for the in-furrow treatments using the xyloglucanase and phospholipase C enzymes or combinations of the two enzymes applied together. Plant height differences for the enzyme treatments were compared to plants grown from seed that received treatment using the wild-type control untransformed host strain (*B. thuringiensis* BT013A; E0).

Xyloglucanase (D381) and phospholipase C (E143) were applied individually and in combination treatments (Table 85). In-furrow applications of xyloglucanase and phospholipase C applied as combination resulted in greater increases in early plant growth as measured by change in plant height (cm) as compared to the wild-type control (*B. thuringiensis* BT013A; E0); (normalized to 100%). Increasing the concentration of xyloglucanase applied in combination with phospholipase C from 1× to 3× resulted in an almost +7% increased plant height over plants that were grown from seed treated with the E0 control. Likewise, increasing the concentration of in-furrow applied phospholipase C (2× and 3×) used in combination with xyloglucanase (1×) resulted in increases in plant growth rate or plant height compared to the 1× applications using both enzymes applied separately as in-furrow treatments or plants grown from control E0 seed (shown in Table 85).

TABLE 85

Effects of xyloglucanase (D381) used in combination with phospholipase C effect on plant height for corn, in-furrow treatment

| Corn Treatment | Percentage Average Plant Height (cm), Normalized to EO Control (In-Furrow)* |
|---|---|
| Xyloglucanase D381 (SEQ ID NO: 299) (1X) | 103.2% |
| Phospholipase C E143 (SEQ ID NO: 250) (1X) | 102.1% |
| Xyloglucanase D381 (SEQ ID NO: 299) (1X) + Phospholipase C E143 (SEQ ID NO: 250) (1X) | 102.7% |
| Xyloglucanase D381 (SEQ ID NO: 299) (2X) + Phospholipase C E143 (SEQ ID NO: 250) (1X) | 103.7% |
| Xyloglucanase D381 (SEQ ID NO: 299) (3X) + Phospholipase C E143 (SEQ ID NO: 250) (1X) | 106.8% |
| Xyloglucanase D381 (SEQ ID NO: 299) (1X) + Phospholipase C E143 (SEQ ID NO: 250) (2X) | 105.8% |
| Xyloglucanase D381 (SEQ ID NO: 299) (1X) + Phospholipase C E143 (SEQ ID NO: 250) (3X) | 103.0% |

*Average of two replicates; 18 plants per replicate

In another experiment, treatments with xyloglucanase (E149) and phospholipase C (E143) were applied as in-furrow treatments to corn and compared to the wild-type control (*B. thuringiensis* BT013A (E0) control (normalized to 100%). The results are depicted in Table 86. Both the xyloglucanase and phospholipase C enzyme applications when applied individually resulted in increased early plant growth rates or increased plant height as compared to plants grown from seed that received the in-furrow treatment with the E0 control. In addition, select in-furrow applications using the combined xyloglucanase and phospholipase C treatments (1× E149:1× E143; 3× E149:1× E143; 1× E149: 2× E143) resulted in increased average plant growth rate over either of the enzymes treatments applied individually and compared to the plant growth for plants grown from seed that received the E0 in-furrow treatment (1×). The greatest increase in plant height resulted in corn that received the in-furrow combination treatment of xyloglucanase E149 (1×) and phospholipase C E143 (2×), a +6% increase over the plants grown from the E0 control-treated seed.

TABLE 86

Effects of xyloglucanase (E149) used in combination with phospholipase C effect on plant height for corn, in-furrow treatment

| Corn Treatment | Percentage Average Plant Height (cm), Normalized to Control (In-Furrow)* |
|---|---|
| Xyloglucanase E149 (SEQ ID NO: 300) (1X) | 104.2% |
| Phospholipase C E143 (SEQ ID NO: 250) (1X) | 103.7% |
| Xyloglucanase E149 (SEQ ID NO: 300) (1X) + Phospholipase C E143 (SEQ ID NO: 250) (1X) | 105.2% |
| Xyloglucanase E149 (SEQ ID NO: 300) (2X) + Phospholipase C E143 (SEQ ID NO: 250) (1X) | 102.8% |
| Xyloglucanase E149 (SEQ ID NO: 300) (3X) + Phospholipase C E143 (SEQ ID NO: 250) (1X) | 104.6% |
| Xyloglucanase E149 (SEQ ID NO: 300) (1X) + Phospholipase C E143 (SEQ ID NO: 250) (2X) | 106.0% |

*Average of two replicates; 18 plants per replicate

Mannanase E177 (SEQ ID NO: 308) (prepared as described in Example 48) applied as an in-furrow treatment resulted in greater early season growth as characterized by an increase in plant height at the V3 stage of development in corn. The enzymes mannanase E177 and phospholipase C E143 applied as an individual enzyme treatment (1×) or in combinations with different application treatments resulted in increased early growth rate benefits as compared to plants grown from seed treated with the E0 control. Mannanases E177 (Table 87) and E196 (Table 88) and phospholipase C were applied individually as enzyme treatments and as combination treatments using mannanase and phospholipase C in-furrow applications to corn. Mannanase E196 (also prepared as described in Example 48) applied as an in-furrow treatment resulted in an average of +5% increase in plant height when tested in a 3 replicate trial and normalized to the plants grown from seed that received the E0 control treatment. The phospholipase C in-furrow treatment also resulted in plants with increased plant height (+2.3%) over the control plants (E0 control). However, the combination in-furrow treatment of mannanase E196 applied using a high dose (3×) and phospholipase C (1×) resulted in a synergistic effect on early season growth with an increased plant height of more than +9% over the plants grown from seed that received an in-furrow treatment with the E0 control.

TABLE 87

Effects of a mannanases (E177) used in combination with phospholipase C (E143) effect on plant height for corn, in-furrow treatment

| Corn Treatment | Percentage Average Plant Height (cm), Normalized to E0 Control (In-Furrow)* |
|---|---|
| Mannanase E177 (SEQ ID NO: 308) (1X) | 103.5% |
| Phospholipase C E143 (SEQ ID NO: 250) (1X) | 102.8% |
| Mannanase E177 (SEQ ID NO: 308) (1X) + Phospholipase C E143 (SEQ ID NO: 250) (1X) | 103.6% |
| Mannanase E177 (SEQ ID NO: 308) (2X) + Phospholipase C E143 (SEQ ID NO: 250) (1X) | 103.3% |
| Mannanase E177 (SEQ ID NO: 308) (3X) + Phospholipase C E143 (SEQ ID NO: 250) (1X) | 103.9% |
| Mannanase E177 (SEQ ID NO: 308) (1X) + Phospholipase C E143 (SEQ ID NO: 250) (2X) | 103.8% |
| Mannanase E177 (SEQ ID NO: 308) (1X) + Phospholipase C E143 (SEQ ID NO: 250) (3X) | 104.6% |

*Normalized to plants grown from seed treated with E0 control as the in-furrow treatment; Average of 3 replicates; 18 plants per replicate

TABLE 88

Effects of a mannanase (E196) used in combination with phospholipase C (E143) effect on plant height for corn, in-furrow treatment

| Corn Treatment | Percentage Average Plant Height (cm), Normalized to Control (In-Furrow)* |
|---|---|
| Mannanase E196 (SEQ ID NO: 307) (1X) | 105.3% |
| Phospholipase C E143 (SEQ ID NO: 250) (1X) | 102.3% |
| Mannanase E196 (SEQ ID NO: 307) (1X) + Phospholipase C E143 (SEQ ID NO: 250) (1X) | 101.2% |
| Mannanase E196 (SEQ ID NO: 307) (2X) + Phospholipase C E143 (SEQ ID NO: 250) (1X) | 103.7% |
| Mannanase E196 (SEQ ID NO: 307) (3X) + Phospholipase C E143 (SEQ ID NO: 250) (1X) | 109.4% |
| Mannanase E196 (SEQ ID NO: 307) (1X) + Phospholipase C E143 (SEQ ID NO: 250) (2X) | 102.9% |
| Mannanase E196 (SEQ ID NO: 307) (1X) + Phospholipase C E143 (SEQ ID NO: 250) (3X) | 104.5% |

*Normalized to plants grown from seed treated with E0 control as the in-furrow treatment; Average of 3 replicates; 18 plants per replicate Phosphatidylinositol phospholipase C E258 and Phospholipase C E80 (prepared as described in Examples 48 and 49, respectively), both which are capable of hydrolyzing phospholipids in the cell membrane and phytase E246 which functions as a phosphatase to mobilize phosphorous from the soil thus creating a useable form for plants were tested in an in-furrow replicated trials. Both of the phospholipase C enzymes (E80 and E258) were provided as an in-furrow treatment using a 1× application and resulted in plants that had an approximate +6% and +7% increase in plant height when compared to plants grown from seed that received the E0 in-furrow treatment at the time of planting. In-furrow treatment with Phytase E246 (1×; 2× and 3×) tested in the same three replicates per trial as phospholipase C also resulted in substantial increases in early seedling vigor and growth as measured by changes in plant height with respective increases of approximately of +7%, +5% and +9% as compared to the in-furrow treatment using the E0 control (Table 89).

TABLE 89

Effects of phospholipase C (E80), phosphatidylinositol phospholipase C (E258) and phytase (E246) applied using varying concentrations, effect on plant height for corn, in-furrow treatment

| Corn Treatment | Concentration (X) | Percentage Change in Average Plant Height (cm), Normalized to E0 Control (In-Furrow)* |
|---|---|---|
| Phospholipase C E80 (signal peptide of SEQ ID NO: 317 directly linked to SEQ ID NO: 250) | 1X | 105.9% |
| Phosphatidylinositol Phospholipase C E258 (signal peptide of SEQ ID NO: 377 directly linked to SEQ ID NO: 375) | 1X | 106.8% |
|  | 2X | 102.4% |
|  | 3X | 101.3% |
| Phytase E246 (SEQ ID NO: 380) | 1X | 107.0% |
|  | 2X | 104.7% |
|  | 3X | 108.7% |

*Average of three replicates; 18 plants per replicate

Corn (Beck's hybrid 5828 YH) seed that contained seed treatments with neonicotinoid systemic pesticides, clothianidin and imidacloprid were tested for compatibility in in-furrow trials tested using two versions of phospholipase C enzymes. Both phospholipase C (E80 and E143) enzymes have the same core phospholipase C sequence (SEQ ID NO: 250). However, phospholipase C E80 also contains an additional secretory signal (SEQ ID NO: 317). In addition, the cloning and expression of phospholipase C E143 enzyme production batch was produced as previously described in Example 48 and the phospholipase C E80 enzyme production batch was produced as described in Example 49. Early plant growth (plant height) was measured using in-furrow comparisons of the phospholipase C enzymes E80 and E143 grown from seed that was treated with PONCHO 600 (clothianidin) and GAUCHO 600 (imidacloprid), neonicotinoid insecticides prior to applying the in-furrow application treatments. Plant growth using the phospholipase C treatments were compared to plants that were grown from seed that received only the seed treatments of PONCHO 600 (clothianidin) and GAUCHO 600 (imidacloprid) insecticides (no in-furrow treatment).

Both the phospholipase C enzymes (E143 and E80) applied as in-furrow treatments provided a growth advantage to plants grown from seed that had the neonicotinoid seed treatments either PONCHO 600 (clothianidin) or GAUCHO 600 (imidacloprid). Plants grown from seed that contained either seed treatment with exhibited an increased plant growth rate or increased overall plant height as compared to plants grown from water treated seed (1×), a +4.3% (PONCHO 600) and a +7.2% (GAUCHO 600) increase compared to plants grown from seed that received a water controls. In-furrow treatment with either phospholipase C (E143) and phospholipase C (E80) provided a growth benefit on top of what was seen with the neonicotinoid seed treatments alone for both combinations with either the PONCHO 600 or GAUCHO 600 neonicotinoid seed treatments (Table 90).

TABLE 90

Effect of phospholipase C enzymes (E80 & E143) applied to corn seed containing neonicotinoid seed treatments, effect on plant height for corn, in-furrow treatment

| Corn In-Furrow Treatment | Percentage Average Plant Height (cm), Normalized to Control (In-Furrow)* |
|---|---|
| Clothianidin (PONCHO 600) Seed Treatment | 104.3% |
| Imidacloprid (GAUCHO 600) Seed Treatment | 107.2% |
| Phospholipase C E143 (SEQ ID NO: 250) (1X) + Clothianidin (PONCHO 600) | 105.3% |
| Phospholipase C E143 (SEQ ID NO: 250) (1X) + Imidacloprid (GAUCHO 600) | 107.8% |
| Phospholipase C E80 (signal peptide of SEQ ID NO: 317 directly linked to SEQ ID NO: 250) (1X) + Clothianidin (PONCHO 600) | 106.5% |
| Phospholipase C E80 (signal peptide of SEQ ID NO: 317 directly linked to SEQ ID NO: 250) (1X) + Imidacloprid (GAUCHO 600) | 108.3% |

*Average of 2 replicates, 18 plants per replicate.

In another experiment, recombinant *Bacillus cereus* family members expressing fusion proteins containing phospholipase C or phospholipase D enzymes were each prepared as described in Example 48 and delivered as an in-furrow treatment to the area surrounding corn seeds (Beck's corn hybrid 5828 YH) in an environment modulating field conditions. Corn seed was planted in 4×4 cm pots filled with 2:1 Timberline 23 top soil to sand with two seeds each planted per pot. Enzyme treatments as described in Tables 90-92 were applied using a 1× (3.5 μL enzyme in 1 mL water) and 2× (7.0 μL enzyme in 2 mL water) treatments as indicated in Tables 91-93 and compared to wild-type control (*B. thuringiensis* BT013A; E0) applied using a 1× treatment. Two to three replicates in a trial as indicated were conducted for each in-furrow treatment, with 18 plants per replicate treatment. Each treatment was randomly assigned to location using a complete randomized block design. Plants were grown on a raised patio with exposure to outside conditions full sunlight (June, 2018) with an approximate 14/10 day/night cycle. All treatments were applied to the soil area directly surrounding each seed after planting but prior to covering the seed with soil. Each pot was initially watered with 50 mL of water to promote germination. After germination, plants were watered using consistent regimes for all treatments. Plant height (an indicator of plant growth rate) was measured at approximately 10 days after planting (DAP) or the transition from V2 to V3 stage of development to determine the effect on very early emergence and seedling vigor. An average plant height per each phospholipase enzyme treatment was normalized to plants grown from seed that received an in-furrow treatment with the BT013A E0 control provided using the 1× application as described (Tables 91-93). Effects of the phospholipase C and phospholipase D enzymes applied using an in-furrow application on corn growth rate (plant height) are shown in Tables 91-93.

Phospholipase D (D409 and E229) enzymes were compared to Phospholipase C (E143) treatments applied in-furrow to corn in plant growth trials grown under outdoor conditions as described above to assess their effect on very early seedling vigor and growth (Table 91). The phospholipase in-furrow treatments were normalized to plants grown from seed that received an in-furrow treatment with the E0 control (1×). Phospholipase D (D409 and E229) applied as in-furrow treatments to corn seed directly after planting resulted in increased growth rates seen in both the 1× and 2× in-furrow treatment applications. The 1× in-furrow treatment with both Phospholipase D D409 and phospholipase D E229 resulted in slightly increased plant height as compared to the 2× treatments with either enzyme. Both the 1× phospholipase D in-furrow treatments resulted in slight increases in corn plant height over the in-furrow treatment with phospholipase C E143 which showed a +5% increase as compared to plants grown from seed that received the E0 control in-furrow treatment.

TABLE 91

Phospholipase C and phospholipase D enzymes, effect on plant height for corn, in-furrow treatment

| Corn In-Furrow Treatment | Percentage Average Plant Height (cm), Normalized to Control (In-Furrow) |
|---|---|
| Phospholipase C E143 (1X) (SEQ ID NO: 250) | 105.0% |
| Phospholipase D D409 (1X) (SEQ ID NO: 256) | 108.5% |
| Phospholipase D D409 (2X) (SEQ ID NO: 256) | 106.5% |
| Phospholipase D E229 (1X) (SEQ ID NO: 260) | 106.6% |
| Phospholipase D E229 (2X) (SEQ ID NO: 260) | 105.8% |

*Average of three trials; 18 plants per trial; measured at 7 DAP

Phospholipase C enzymes from *Listeria monocytogenes* (Lm. D473, D474 and D475) were compared to a phospholipase C from *Bacillus thuringiensis* (E80) that has been shown to have plant growth promoting effects. In-furrow treatments were applied to corn seed that was planted in two outdoor trials as previously described using different applications at a 1× and 2× concentration. The phospholipase C enzymes all contain the same core sequence (SEQ ID NO: 374) but differ with respect to the secretory signal and propeptide sequences. D473 contains the secretory signal (SEQ ID NO: 376) directly linked to SEQ ID NO: 373 (which contains a propeptide sequence). D474 is just SEQ ID NO: 373 without the secretory signal. D475 (SEQ ID NO: 374) lacks both the signal secretory sequence and the propeptide sequence.

Phospholipase C (E80) used as a 1× in-furrow treatment on corn seed resulted in plants that had a +12% increase in plant height over the plants grown from seed treated with the E0 control. In-furrow treatments using Lm phospholipase C (D473, D474 and D475) applied using the 1× or 2× concentrations all resulted in plants with increased plant height over the plants grown from seed that received the E0 control treatment. These in-furrow treatments with Lm phospholipase C (D473, D474 and D475) also resulted in plants with slight increased plant height compared to the in-furrow treatment using phospholipase C E80. All of the 1× in-furrow treatments with Lm phospholipase (D473, D474 and D475) resulted in plants with increased plant height compared to the 2× in-furrow treatments with the same phospholipase C enzymes. The 1× in-furrow treatment using Lm phospholipase C D475 enzyme resulted in corn plants with increased plant height, a more than +20% increase compared to plants grown from seed that received the in-furrow treatment using the E0 control.

TABLE 92

Phospholipase C enzymes, effect on plant height for corn, in-furrow treatment

| Corn In-Furrow Treatment | Percentage Average Plant Height (cm), Normalized to Control (In-Furrow)* |
|---|---|
| Phospholipase C E80 (1X) (signal peptide of SEQ ID NO: 317 directly linked to SEQ ID NO: 250) | 112.1% |
| Lm Phospholipase C D473 (1X) (the signal peptide of SEQ ID NO: 376 directly linked to SEQ ID NO: 373) | 114.0% |
| Lm Phospholipase C D473 (2X) (the signal peptide of SEQ ID NO: 376 directly linked to SEQ ID NO: 373) | 112.5% |
| Lm Phospholipase C D474 (1X) (SEQ ID NO: 373) | 115.2% |
| Lm Phospholipase C D474 (2X) (SEQ ID NO: 373) | 112.7% |
| Lm Phospholipase C D475 (1X) (SEQ ID NO: 374) | 120.6% |
| Lm Phospholipase C D475 (2X) (SEQ ID NO: 374) | 113.6% |

*Average of two replicates; 18 plants per replicate; measured at 10 DAP

Recombinant *Bacillus cereus* family members expressing fusion proteins containing pectolyase enzymes (D405 and D176), prepared as described in Example 48, were applied in-furrow directly after planting the seeds resulted in substantial increases in plant height and compared to plants grown from seed that received in-furrow treatments using the E0 control. Pectolyases (endopolygalacturonase (D405) and pectin lyase (E176)) applied as in-furrow treatments at 1× and 2× concentrations resulted in similar increases in average plant height averaged over the three trials, an average of +12% (D405) and +8% (E176) as compared to plants grown from seed that received the in-furrow E0 control treatment. Phospholipase C from *Bacillus thuringiensis* (E80) that has been shown to have plant growth promoting effects also resulted in positive increases in plant height, a +5% increase as compared to the E0 control plants (Table 93).

TABLE 93

Pectolyase enzymes, effect on plant height for corn, in-furrow treatment

| Corn In-Furrow Treatment | Percentage Average Plant Height (cm), Normalized to Control (In-Furrow) |
|---|---|
| Phospholipase C E80 (1X) (signal peptide of SEQ ID NO: 317 directly linked to SEQ ID NO: 250) | 105.2% |
| Endopolygalacturonase D405 (1X) (signal peptide of SEQ ID NO: 346 directly linked to SEQ ID NO: 309) | 111.2% |
| Endopolygalacturonase D405 (2X) (signal peptide of SEQ ID NO: 346 directly linked to SEQ ID NO: 309 ) | 112.0% |
| Pectin lyase E176 (1X) (SEQ ID NO: 310) | 108.2% |
| Pectin lyase E176 (2X) (SEQ ID NO: 310) | 107.5% |

*Average of three replicated trials; 18 plants per trial; measured at 10 DAP

Example 52: Seed Treatment with Enzymes Results in Increased Green Canopy Cover in Soybean Fractional green canopy cover (FGCC) is a diagnostic analysis tool (Canopeo) used to estimate green canopy area.

Canopeo (Matlab, Mathworks, Inc., Natick, MA) provides a measurement tool based on the selection criteria for green canopy area that is determined using color ratios of red to green (R/G) and blue to green (B/G) which compensates for excess green index or background. FGCC cover ranges from 0 (0% green canopy cover) to 1 (100% green canopy cover). The classification of green canopy is based on the following criteria:

$$R/G<P_1 \text{ and } B/G<P_2 \text{ and } 2G-R-B>P_3$$

Where $P_1$ and $P_2$ are parameters that have a value near 1 to classify the pixels that are in the green wavelength band range (500-570 nm), and $P_3$ is a parameter that sets the minimum excess green vegetation and allows for background subtraction. The default parameter values for Canopeo are $P_1$=0.95, $P_2$=0.95, and $P_3$=20.

Soybean plants (variety 424L4) were grown from seed that received seed treatments with enzymes: xyloglucanase, mannanase, β-1,4-endoglucanase, xylanase, phospholipase, pectolyase and lichenase. Recombinant *Bacillus cereus* family members expressing fusion proteins containing various enzymes were prepared as described above in Example 48 (xyloglucanase, mannanase, xylanase, pectolyase, lichenase, and phospholipase) or Example 47 (endoglucanase), and were delivered as a seed treatment onto soybean seeds using the volumes (μL) applied to the outer coats of each seed as a seed treatment and indicated in Table 94-97. A wild-type control (*B. thuringiensis*; E0 no-enzyme) control was also applied to seed using a volume of 1 μL per seed and used as a control comparison for the enzyme treatments Soybean seed that received the seed treatments with the enzymes as described and the E0 control treatments were allowed to dry and then planted in 4×4 cm pots seeded into a mixture of 2:1 Timberline Top soil to sand with two seeds each planted per pot and initially watered with 50 mL of water to promote germination. Each enzyme treatment and a water control treatment (no seed treatment) were seeded into 3 trays that represented separate replicates per enzyme treatment and grown in an outdoor facility. Within each experiment, the same number replicate trays and total plants per treatment was held consistent between treatments. Each tray supported 18 plants per treatment. The trays were randomized between the treatments. Plants grown in an outdoor facility were exposed to similar environmental parameters that simulated a field planting (May, 2018). The soybean plants were grown for approximately 12 to 14 days until the unifoliate leaf stage or for 20 day until the trifoliate leaf stage. At both of these stages the leaves were fully expanded. FGCC was determined using the Canopeo measurement tool and the images were collected 50 cm above the bottom of the plant trays using a selection parameter of 0.91 resolution. Twenty representative images were collected per each treatment and analyzed to classify all the pixels in each image. A representative pixel classification assigned for the 20 images per treatment per tray. FGCC was then calculated for the soybean plants in each tray or treatment replicate and then further calculated on a per plant basis for each tray (trial). Results are shown for the different enzyme seed treatments in Tables 94-98. Differences in FGCC were reported as a percentage of green canopy and normalized to soybean plants grown from seed that only received a water control treatment in Tables 94-96. Differences in FGCC were reported as a percentage of green canopy and normalized to soybean plants grown from seed that received the E0 treatment control in Tables 97-98.

Xyloglucanase and Mannanase The wild-type control (*B. thuringiensis* BT013A E0, no-enzyme control) resulted in plants with increased green canopy area normalized to the soybean plants grown from seeds that received the water only seed treatment. Xyloglucanase (SEQ ID NO: 299) and mannanase (SEQ ID NO: 307) provided as seed treatments both increased green canopy area in soybean measured at 14 DAP (unifoliate leaf stage). The amount of the seed treatment application (1 μL to 3 μL per seed) varied as to the effect on FGCC. All of the xyloglucanase D381 (SEQ ID NO: 299) provided as seed treatments applied at 1 μL, 2 μL or 3 μL per seed resulted in positive outcomes of an increase in green canopy area (FGCC) with a respective +18.1% (1 μL), +23.3% (2 μL) and +14.7% (3 μL) increase in FGCC over the plants grown from seed that received the water control (Table 94). Mannanase E196 (SEQ ID NO: 307) provided as a soybean seed treatment also showed increased FGCC but only with the 1 μL and 3 μL application doses, respective increases of +17.4% and +12.4% compared from plants grown from seed that received the water control (Table 94).

TABLE 94

Seed treatment using xyloglucanase and mannanase enzymes increased green canopy area in soybean (unifoliate leaves).

| Treatment | Volume | Unifoliate Stage Leaf Trial = 3 Replicate Trays Percentage FGCC per Plant Normalized to Control* |
|---|---|---|
| E0 Control (*B. thuringiensis* BT013A) | 1 μL | 105.9% |
| Xyloglucanase D381 (SEQ ID NO: 299) | 1 μL | 118.1% |
| | 2 μL | 123.3% |
| | 3 μL | 114.7% |
| Mannanase E196 (SEQ ID NO: 307) | 1 μL | 117.4% |
| | 2 μL | 99.3% |
| | 3 μL | 112.4% |

*Normalized to water control seed treatment (1 μL)

Pectolyase and Lichenase

Pectolyase enzymes comprising pectin lyase E176 (SEQ ID NO: 310) and endopolygalacturonase D405 (signal peptide of SEQ ID NO: 346 directly linked to SEQ ID NO: 309) were assessed as seed treatments in the same trials using 3 replicate trays per trial for effects on FGCC at the trifoliate leaf stage (20 DAP). Lichenase D436 (SEQ ID NO: 296) was also assessed as a soybean seed treatment for effect on FGCC at the trifoliate leaf stage (20 DAP). Each of the 3 trays per enzyme and E0 control treatments contained 18 plants with the entire tray consisting of one enzyme treatment. Calculations for green canopy area or FGCC was normalized to plants grown from water control treated seed. Seed treatment enzymes (pectin lyase E176, endopolygalacturonase D405 and lichenase) used seed treatment volumes which are described in Table 95 below. The E0 base control was applied using a 1 μL volume per seed.

TABLE 95

Seed treatment using pectolyase and lichenase enzymes increased green canopy area in soybean (unifoliate and trifoliate leaves).

| Treatment | Volume | Trifoliate Leaf Trial = 3 Replicate Trays per Treatment Percentage FGCC per Plant Normalized to Control* |
|---|---|---|
| E0 Control (*B. thuringiensis* BT013A) | 1 μL | 123.5% |
| Pectin lyase E176 (SEQ ID NO: 310) | 1 μL | 121.9% |
| | 2 μL | 114.7% |
| | 3 μL | 129.0% |
| Endopolygalacturonase D405 (signal peptide of SEQ ID NO: 346 directly linked to SEQ ID NO: 309) | 1 μL | 114.9% |
| | 2 μL | 172.9% |
| | 3 μL | 124.6% |
| Lichenase (β-1,3-1,4-endoglucanase) licB D436 (SEQ ID NO: 296) | 1 μL | 114.2% |
| | 0.5 μL | 112.7% |
| | 0.25 μL | 114.3% |

*Normalized to water control seed treatment

Pectin lyase E176 (SEQ ID NO: 310) applied as a seed treatment using 1-3 μL volumes per seed resulted in plants that had the highest values for FGCC when compared to pants grown from seed that received a water control (Table 95). The highest FGCC values were obtained for plants that received the 3 μLand a +29% (trifoliate) average increase for FGCC over the 3 replicate trays (normalized to green canopy area for plants grown from seed treated with water alone). The endopolygalaturonase D405 seed treatment also resulted in plants with increased FGCC, which was higher in the 2 μL and 3 μL volumes of the production batch applied to the seed. The trifoliate leaves of soybean plants grown from seed treated with 2 μL of endopolygalacturonase D405 per seed had substantial increased FGCC, an almost +73% increase in plants grown to the trifoliate leaf stage (20 DAP) as compared or normalized to the same age plants grown from the water control treated seed. Lichenase D436 was applied using lower volumes as a seed treatment to soybean (0.25 μL, 0.5 μLand 1 μL volumes). The lower application of lichenase D436 (0.25 L) resulted in a greater increase in FGCC in plants at the trifoliate (20 DAP) leaf stage. An increase of FGCC of approximately +14% (trifoliate) is shown as the average of for the 3 trays and compared to plants from the water control treatment.

Phospholipase C

Phospholipase C (PLC) originally derived from *Listeria monocytogenes* was cloned using different versions with a secretory sequence or a propeptide or both attached to the core PLC sequence to examine if these accessory sequences contributed to increases in FGCC in soybean plants that received the seed treatments using PLC. Lm Phospholipase D473, D474, and D475 were described in Example 51, above. Each of the Lm. PLC treatments were applied using 2 μL of production enzyme which was applied directly to each soybean seed prior to planting and compared to the FGCC of plants grown from seed that received water (1 μL per seed). The FGCC values for the Lm. PLC D475 that had just the core PLC sequence (2 μL) resulted in a higher average FGCC, a +22.3% increase as measured for the trifoliate leaves as compared to the Lm. PLC D473 or Lm. PLC D473 (2 μL) treatments. However, all three Lm. PLC (D473, D474 and D475) all had higher increased green canopy area or FGCC at the trifoliate leaf stage when normalized to plants at the same stage that were grown from the water control treated seed.

TABLE 96

Seed treatment using phospholipase C enzymes increased green canopy area in soybean (trifoliate leaves).

| Treatment | Volume | Trifoliate Trial = 3 Replicate Trays Percentage FGCC per Plant Normalized to Control* |
|---|---|---|
| Phospholipase C D473 (secretory sequence + propeptide) *Listeria monocytogenes* (the signal peptide of SEQ ID NO: 376 directly linked to SEQ ID NO: 373) | 2 µL | 104.7% |
| Phospholipase C D474 (+propeptide) *Listeria monocytogenes* (SEQ ID NO: 373) | 2 µL | 112.2% |
| Phospholipase C D475(no secretory sequence or propeptide) *Listeria monocytogenes* (SEQ ID NO: 374) | 2 µL | 122.3% |

*Normalized to plants grown from water control treated seed.

Xylanase and Endoglucanase

Xylanase E100 (signal sequence of SEQ ID NO: 328 directly linked to SEQ ID NO: 268) and xylanase E232 (SEQ ID NO: 273) were compared to each other as seed treatments to effect changes in green canopy area in soybean plants grown to the unifoliate leaf stage (14 DAP). Xylanase treatments were also compared to the plants grown from soybean seed treated with the β-1,4-endoglucanase E94 (signal sequence of SEQ ID NO: 334 directly linked to SEQ ID NO: 293) enzyme. FGCC values for all the enzyme treated seed are reported as normalized to plants grown from *B. thuringiensis* BT013A; E0, no-enzyme control) in Table 97. Soybean plants had comparable FGCC values from plants grown from seed that received a seed treatment with xylanase E100 provided at 1 µL and β-1,4-endoglucanase E94. Both resulted in plants that had approximately over a +4% increase in green canopy area when normalized to plants grown from seed that received the E0 control. Xylanase E232 used as a seed treatment also provided using a 1 µL volumes of the production batch enzyme per seed resulted in an almost +7% increase in FGCC values in plants (14 DAP) when compared to plants grown from the E0 control treated seed.

TABLE 97

Seed treatment using endoglucanase and xylanase enzymes increased green canopy area in soybean (unifoliate leaves).

| Treatment | Unifoliate Leaf Stage Trial = 3 Replicate Trays Percentage FGCC per Plant Normalized to Control* |
|---|---|
| β-1,4-endoglucanase E94 (signal sequence of SEQ ID NO: 334 directly linked to SEQ ID NO: 293) | 104.6% |
| Xylanase E100 (signal sequence of SEQ ID NO: 328 directly linked to SEQ ID NO: 268) 1 µL | 104.3% |
| Xylanase E232 (SEQ ID NO: 273) 1 µL | 106.7% |

*Normalized to plants grown from *B. thuringiensis* BT013A; E0, no-enzyme control) treated seed Other Phospholipases Phospholipase D D409 (SEQ ID NO: 256) and phospholipase E229 (SEQ ID NO: 260) were compared to phospholipase C E143 (SEQ ID NO: 250) after plants grown from the enzyme treated seed was normalized to the *B. thuringiensis* BT013A (E0 control). The two phospholipase D enzymes applied as seed treatments using either a 1 µL or a 2 µL volume of the production batches per seed differed with respect to the FGCC values compared to plants grown from seeds that received the E0 control treatment as shown in Table 97. All of the plants grown from seed that received the phospholipase D (D409 and E229) seed treatments resulted in an average overall increased FGCC as compared to plants from seeds that received the phospholipase C (E143) treatment applied at the same volume (1 µL). An increase in FGCC of +5% for phospholipase D D409 and a +19% for phospholipase D E229 over the plants that were grown from seed that received the seed treatment with phospholipase C E143. However, all of the phospholipase seed treatments produced plants with higher FGCC values as compared to or normalized to plants grown from *B. thuringiensis* BT013A; E0, no-enzyme control) treated seed.

TABLE 98

Seed treatment using phospholipase enzymes increased green canopy area in soybean (unifoliate leaves).

| Treatment | Volume | Unifoliate Leaf Stage Trials = 3 Replicate Trays Per centage FGCC per Plant Normalized to Control* |
|---|---|---|
| Phospholipase C E143 (SEQ ID NO: 250) | 1 µL | 112.2% |
| Phospholipase D D409 | 1 µL | 117.4% |
| (SEQ ID NO: 256) | 2 µL | 121.8% |
| Phospholipase D E229 | 1 µL | 131.2% |
| (SEQ ID NO: 260) | 2 µL | 121.4% |

*Normalized to plants grown from *B. thuringiensis* BT013A; E0, no-enzyme control) treated seed

Example 53: Seed Treatment with Enzymes Results in Increased Yield in Soybean Replicated field trials were conducted using two soybean varieties, (Beck's 297R4 and 312R4) at U.S. Midwest locations. The soybean varieties were grown in three separate locations, variety Beck's 297R4 (OH, WI & IA) and Beck's 312R4 (IN, IL, IA) for yield trials conducted using lichenase and mannanase enzymes and in 3 separate locations in Illinois for Beck's 297R4 and Beck's 38X52N for yield trials conducted using ACC deaminase and lactonase enzymes. Seed from soybean varieties contained a base seed treatment containing EverGol Energy (65 mL per 100 kg of seed), GAUCHO 600 (0.12 mg active ingredient/per seed) and ILeVO (0.15 mg active ingredient fluopyram (48.4%) per seed). Recombinant *Bacillus cereus* family members (prepared as described above) were applied as seed treatments using the fluid ounce equivalent use rates as described in Tables 99-102 and applied on top of the base seed treatment. Enzymes applied as seed treatments were allowed to dry on the outer surface of the seed prior to planting.

Soybean seed was planted at 1.5 to 2 inches (3.8 to 5.1 cm) depth to assure normal root development. Soybean seed was planted at approximately 150,000 plants per acre with row widths of 30-inch (76.2 cm) rows with seed spacing of approximately 7 to 8 seeds per foot (0.3 meter). Field seed beds at each location were prepared using conventional or conservation tillage methods for the plantings. Fertilizer was applied as recommended by conventional farming practices and remained consistent between the US Midwest locations. Herbicides were applied for weed control and supplemented with cultivation when necessary.

Yield (Bu/Ac) from soybean plants that were grown from seed that received seed treatments with lichenase (E111) was compared to plants grown from seed that received the base seed treatment (control; no enzyme). Average yield and the change in yield over the control plants is reported individually for the two soybean varieties for the 3 locations harvested in Table 99.

TABLE 99

Yield: Lichenase as a seed treatment increased yield in soybean

| Treatment | Average Yield (Bu/Ac) Variety: Beck's 297R4 (Change in Yield Compared to Control) | Average Yield (Bu/Ac) Variety: Beck's 312R4 (Change in Yield Compared to Control) |
|---|---|---|
| Base Seed Treatment Control | 58.89 (−) | 63.33 (−) |
| Lichenase E111 (signal peptide of SEQ ID NO: 335 directly linked to SEQ ID NO: 295) 2.5 Fl. oz use rate equivalent | 62.33 (+3.34) | 64.78 (+1.45) |

Soybean grown from seeds that received lichenase as a seed treatment had greater yields as compared to soybean plants that were grown from seed that received the base seed treatment (control) for both Beck's 297R4 and Beck's 312R4 varieties. The average yield (Bu/Ac) increases for the 3 locations differed between varieties, yet both had positive increases in yield as compared to the yield from the control plants. Beck's variety 297R4 had on average a +3.34 Bu/Ac (224.6 kg/Ha) increase while Beck's 312R4 had a +1.45 Bu/Ac (97.5 kg/Ha) increase as compared to yield harvested from the control plants.

In another replicated field trial, yield (Bu/Ac) was collected from soybean plants that were grown from seed that received seed treatments with mannanase (E177) and compared to plants grown from seed that received the base seed treatment (control; no enzyme). Average yield and the change in yield over the control plants is reported in Table 100 for the 3 locations harvested.

TABLE 100

Yield: Mannanase as a seed treatment increased yield in soybean

| Treatment | Average Yield (Bu/Ac): Variety: Beck's 297R4 (Increased yield over Control) |
|---|---|
| Base Seed Treatment Control | 58.89 (−) |
| Mannanase E177 (SEQ ID NO: 308) 2.5 Fl. oz use rate equivalent | 61.00 (+2.11) |

Soybean (Beck's variety 297R4) that received the seed treatment with mannanase (E177) enzyme had increased yield as compared to soybean plants grown from seed that received only the base seed treatment control. Soybean plants grown from seed treated with mannanase had an average yield increase of +2.11 Bu/Ac (142 kg/Ha) across the 3 locations as compared to yield from the control plants.

Yield (Bu/Ac) from soybean plants that were grown from seed that received seed treatments with ACC deaminase was compared to plants grown from seed that received the base seed treatment (control; no enzyme). Average yield and change in yield over the control plants is reported in Table 101 individually for the two soybean varieties (Beck's 297R4 and Beck's 38X52N) for the 3 locations harvested.

TABLE 101

ACC Deaminase as a seed treatment increased yield in soybean

| Treatment | Average Yield (Bu/Ac) Variety: Beck's 297R4 (Increased yield over Control) | Average Yield (Bu/Ac) Variety: Beck's 38X52N (Increased yield over Control) |
|---|---|---|
| Base Seed Treatment Control | 66.23 (−) | 61.57 (−) |
| ACC Deaminase D406 (SEQ ID NO: 249) 2 Fl. oz use rate equivalent | 67.14 (+0.91) | 62.28 (+0.71) |

Soybean that received the seed treatment with the ACC deaminase (D406) enzyme had an increased yield as compared to soybean plants grown from seed that received only the base seed treatment control. Soybean plants (Beck's variety 2974R4) grown from seed treated with ACC deaminase had an average yield increase of +0.91 Bu/Ac (61.2 kg/Ha) whereas (Beck's variety 38X52N) had an average yield increase of +0.71 Bu/Ac (47.7 kg/Ha) across the 3 locations as compared to yield from the control plants.

In another replicated field yield trial conducted at 3 U.S. Midwest locations (IL), yield (Bu/Ac) is reported from soybean plants that were grown from seed that received seed treatments with lactonase (H51) enzyme and compared to plants grown from seed that received the base seed treatment (control; no enzyme). Average yield and change in yield over the control plants is reported in Table 102 individually for the two soybean varieties (Beck's 297R4 and Beck's 38X52N) harvested.

TABLE 102

Lactonase as a seed treatment increased yield in soybean

| Treatment | Average Yield (Bu/Ac) Variety: Beck's 297R4 (Increased yield over Control) | Average Yield (Bu/Ac) Variety: Beck's 38X52N (Increased yield over Control) |
|---|---|---|
| Base Seed Treatment Control | 66.23 (−) | 61.57 (−) |
| Lactonase H51 (SEQ ID NO: 277) 2 Fl. oz use rate equivalent | 67.03 (+0.80) | 65.36 (+3.79) |

Yield increase in soybean plants grown from seed that received a treatment with the lactonase (H51) enzyme differed between the 2 soybean varieties (Beck's 297R4 and Beck's 38X52) grown in the 3 locations (IL). Soybean plants (Beck's 38X52N) had a +3.79 Bu/Ac (254.9 kg/Ha) yield increase over soybean grown from seed that received the base seed treatment (no enzyme). Soybean plants (Beck's 297R4) had a slight +0.80 Bu/Ac (53.8 kg/Ha) yield increase over the control plants.

Example 54: Gastric Digestive Juice Assay to Confirm Active Enzymes for Use as Feed Additives in Agricultural Animals Enzymes, expressed on the exosporium of recombinant *Bacillus cereus* family members as described herein, that are useful as feed additives were characterized for activity using an in vitro test system that simulates gastrointestinal conditions to assess the accessibility of these enzymes as they enter and pass through the digestive juices found in the gut and the gastrointestinal track of a mammal, such as a bovine species. The mammalian model was adapted from Kaufman et. al., 2007 (Kaufman et al., "Lead bioaccessibility in food web intermediates and the influence on ecological risk characterization", Environmental Science and Technology 2007; 41: 5902-5907).

A mammalian physiologically based extraction test (PBET) was conducted using the digestive and intestinal juices acquired from bovine and sampled using separate times including a time zero (T0) sampling to simulate the enzyme activity state during the consumption of feed. Two stages of the digestion process during bovine digestion were carried out using known amounts of each of the enzymes generated using batch production fermentation methods as previously described (Table 80) to achieve the desired activity levels. The first stage (Stage 1) digestion process used a 2-step collection process to simulate the gastric juices from a recently fed animal (T0) and juices during the digestion process "steady state" (T1). The second stage (Stage 2) digestion process used a 2-step collection process to simulate passage through the intestine and monitoring activity of the feed enzymes at two-time points; slow intestinal passage (T3) and just prior to the end of intestinal passage (T4).

For Stage 1: The PBET assay was conducted using a gastric digestive juice containing: pepsin (1.25 g/L), malic acid (0.5 g/L), citric acid (0.5 g/L), lactic acid (420 μL/L), acetic acid (500 μL/L) in deionized water and adjusted to pH 4.0 to simulate a just fed animal and pH 2.5 to simulate steady state conditions during food digestion. The initial (Stage 1) PBET reactions used 4 mL of the gastric digestive juice combined with the "feed additive" enzyme in to a 15 mL centrifuge tube placed at 37° C. for 10 min. After the 10 min. incubation time, the tubes were kept at 37° C. but shaken at 250 rpm at a 45° C. angle for 1 hour. Time points were taken during the reaction to simulate the consumption of food in the stomach. Multiple samples at each time points were collected during the hour incubation T0 (just fed); and T1 (digestion started reaching steady state levels) time intervals. At each collection point, the shaker was stopped an aliquot of 100 μL of gastric juice containing the "feed additive" enzyme was collected from each tube. The gastric juice samples were then transferred separately to a 1.5 mL sealed microcentrifuge tube and immediately centrifuged for 10 min. at 11,000×g. The supernatant from each sample was decanted into a fresh tube and the supernatant fraction was collected and stored at −20° C. until the time for the initiation of the enzyme-specific activity assays.

Once the Stage 1 digestive stimulation was completed, the digestive juice in each simulation reaction was adjusted to pH 7.0 using 300 μL of $NaHCO_3$ solution. For Stage 2: After the pH had been adjusted, a 10× concentrated solution that simulated a digestive juice found in the bovine intestine was added to the reaction mixtures of each sample which contained bile extract (26 mg/mL) and pancreatin (7.5 mg/mL to achieve the desired 1× final concentrations (bile extract=2.6 mg/mL and pancreatin=0.75 mg/mL). This intestinal solution was added to each replicate sample prior to returning the sample tubes to the shaker at 37° C., 45° angle and shaking at 100 to 150 rpm to mimic the slow intestinal passage of the "feed additive" enzymes. A 100 μL aliquot of the intestinal solution was taken from each tube after a 1-hour incubation interval for the T3 time interval (slow intestinal passage). Tubes were then returned to the shaker and incubated for a total time of 3.5 hours (almost complete passage through the intestine: end of the intestinal simulation) collected for the T4 time interval. The samples were then transferred to a 1.5 mL sealed microcentrifuge tube an immediately centrifuged for 10 min. at 11,000×g. The supernatant was decanted into a fresh tube and the supernatant was stored at −20° C. until further assayed using enzyme-specific assays.

Enzymes selected for use as feed additives were compared to commercially available highly purified (free) enzymes with known activity levels; the positive controls (free enzyme) from each enzyme class as described in Table 103. The "feed additive" enzymes and the commercial enzymes were assayed with the digestive enzymes to confirm that the enzyme-specific assays were functional and could be used as comparisons for the "feed additive" enzymes to ensure that they maintained a functional activity as they passed through the digestive track of mammal, such as a bovine mammal.

TABLE 103

Commercially available enzymes used as positive control comparisons to production batch enzymes used in a simulated mammalian gastric digestion assay

| Enzyme Positive Control | EC No: | Catalog No. (CAS) | Specific Activity (U/mg) |
|---|---|---|---|
| Xyloglucanase (GH74) *Paenibacillus* sp. | 3.2.1.155 | Megazyme E-XGP74 (1000598-79-7/76901-10-5) | 45 |
| Lichenase (endo-1,3,1,4-β-Glucanase) *Bacillus subtilis* | 3.2.1.73 | Megazyme E-LICHN (37288-51-0) | 230 |
| Mannanase (endo-1,4 β-Mannanase) *Bacillus* sp. | 3.2.1.78 | Megazyme E-BMABS (37288-54-3) | 50 |
| Xylanase (endo-1,4-β-Xylanase) *Neocallimastix patriciarum* | 3.2.1.8 | Megazyme E-XYLNP (9025-57-4) | 1000-1500 |

TABLE 103-continued Commercially available enzymes used as positive control comparisons to production batch enzymes used in a simulated mammalian gastric digestion assay

| Enzyme Positive Control | EC No: | Catalog No. (CAS) | Specific Activity (U/mg) |
|---|---|---|---|
| Endoglucanase (endo-1,4-β-D-Glucanase) *Acidothermus cellulolyticus* | 3.2.1.4 | Sigma-Aldrich E2164 (9012-54-8) | 2 |

Enzyme-specific enzyme activity assays were conducted on each 100 µL aliquot as collected for the stage 1 (digestion through the stomach; T0 and T1) and stage 2 (movement through the intestine; T3 and T4) digestive assays. A representative standard curve for enzymes in Table 104 was obtained using glucose as a cleavable and detectable substrate and resulted in the following equation: $y=12.511x^3 - 398.76x^2 + 448.51x + 40.714$ ($R^2=0.9994$). The $R^2$ value of 0.9994 for the standard curve was highly positively correlated to the individual enzyme specific activities and was used to determine the starting and ending activities for each of the feed additive enzymes in Stages 1 and 2 of the digestion assays.

Lichenase E111, mannanases E177 and E196, xylanases E232, E146, and E100, and xyloglucanases E149 and D381 (all prepared as described above in Example 48) were tested as feed additive enzymes and were compared to the background activity of the E0 control (*Bacillus thuringiensis* BT013A, the same strain as used to express the recombinant enzymes). In addition, the effectiveness of mannanase as a free enzyme to act as a feed additive and remain active during digestion was tested. Mannanase D448 and D449 were prepared as free enzymes using the pFEe4B vector (which contains ampicillin and tetracycline resistance genes) in *Bacillus subtilis*. The pFe4B vector carries segments enabling replication and selection in *Bacillus* and *E. coli*. The *E. coli* section (pUC57) contains the ColE1 origin of replication and bla, while the *Bacillus* section (pBC16) harbors repU, oriU and tetL. In this study, the pBC section was further augmented with expression cassettes for mannanase (D448 or D449) and lacI. The lacI cassette is driven by a *Bacillus paralicheniformis* penicillase promoter and results in constitutive expression of *E. coli* LacI needed to suppress expression of the cargo of interest prior to induction. The expression cassette for the mannanases contained a modified *Bacillus subtilis* groE operon promoter fused to the binding site for LacI. The mannanase was further fused to the amyQ secretion signal of *Bacillus amyloliquefaciens* to ensure its secretion outside of the producing cell. pFEe4B derivatives carrying mannanase were transformed into *Bacillus subtilis* and expression was induced by addition of isopropyl β-D-1-thiogalactopyranoside (IPTG). The whole cell broth was filtered and the supernatant (filtrate) used as the final product in this example. Note that whole cell broth, centrifugates, or filtrates can be used as described herein.

All four enzyme types produced in the BT013A strain with a BclA20-35 targeting sequence (amino acids 20-35 of SEQ ID NO: 1) had activity at the start of the digestive simulation and were able to maintain some activity throughout the simulation (Table 104). This suggests that throughout the process the animal would have access to more freed carbohydrates and sugars to convert into energy. The free enzymes (D448 and D449), however, showed a drop in activity over time during the assay. Thus, this data demonstrate the stability of the sporulated enzymes in this assay, supporting their ability to stay with the feed throughout the process and not be readily absorbed across the epithelium, which would reduce their ability to continue to digest target substrates throughout the stomach and intestines as the conditions become more favorable to enzyme activity.

TABLE 104

Enzymes as feed additives retain activity in a simulated mammalian gastric digestion assay

| | Treatment Activity Assay (mU/mL) With Digestive Enzymes (% normalized to T0) | | | |
|---|---|---|---|---|
| Time Intervals | T0 | T1 | T3 | T4 |
| Lichenase Positive Control | 28,769.01 (100%) | 30,160.20 (104.8%) | — | — |
| Lichenase E111 (signal peptide of SEQ ID NO: 335 directly linked to SEQ ID NO: 295) | 51.71 (100%) | 47.11 (91.1%) | 31.64 (61.2%) | 36.25 (70.1%) |
| Mannanase Positive Control | 11,694.45 (100%) | 11,659.79 (99.7%) | 12,804.54 (109.5%) | 11,798.45 (100.9%) |
| Mannanase E177 (SEQ ID NO: 308) | 79.76 (100%) | 84.21 (105.6%) | 89.49 (112.2%) | 89.93 (112.7%) |
| Mannanase E196 (SEQ ID NO: 307) | 77.97 (100%) | 80.21 (102.9%) | 83.77 (107.4%) | 83.32 (106.9%) |
| Mannanase D448 (SEQ ID NO: 308)* | 23,038.02 (100%) | 29,411.29 (127.7%) | 18,546.06 (80.5%) | 10,238.15 (44.4%) |

TABLE 104-continued

Enzymes as feed additives retain activity in a simulated mammalian gastric digestion assay

| Time Intervals | Treatment Activity Assay (mU/mL) With Digestive Enzymes (% normalized to T0) | | | |
|---|---|---|---|---|
| | T0 | T1 | T3 | T4 |
| Mannanase D449 (SEQ ID NO: 307)* | 32,685.35 (100%) | 39,757.90 (121.6%) | 7,671.66 (23.5%) | 4,429.49 (13.5%) |
| Xylanase Positive Control | 354.92 (100%) | 426.59 (120.2%) | 451.56 (127.2%) | 492.94 (138.9%) |
| Xylanase E232 (SEQ ID NO: 273) | 30.85 (100%) | 31.54 (102.2%) | 29.73 (96.4%) | 35.02 (113.5%) |
| Xylanase E146 (SEQ ID NO: 268) | 26.88 (100%) | 26.98 (100.4%) | 27.05 (100.6%) | 37.98 (141.3%) |
| Xylanase E100 (signal peptide of SEQ ID NO: 328 directly linked to SEQ ID NO: 268) | 24.59 (100%) | 24.49 (99.6%) | 31.24 (127.0%) | 29.51 (120.0%) |
| Xyloglucanase Positive Control | 407.42 (100%) | 329.65 (80.9%) | 416.05 (102.1%) | 360.98 (88.6%) |
| Xyloglucanase E149 (SEQ ID NO: 300) | 21.27 (100%) | 21.27 (100%) | 24.90 (117.1%) | 23.87 (112.2%) |
| Xyloglucanase D381 (SEQ ID NO: 299) | 151.59 (100%) | 37.71 (24.9%) | 24.78 (16.3%) | 27.83 (18.4%) |

*Mannanases E177/E196 share the same sequence as Mannanases D448 and D449 but the expression systems were different. Mannanases E177 and E196 were expressed as described in Example 48 and displayed on the exosporium of *Bacillus thuringiensis* BT013A; Mannanases D448 and D449 were express from the acidic environment of the gut allowed by the longer BclA targeting sequence or CotY.

In other assays, another model can be used to characterize the activity of the present "feed additive" enzymes of the present invention using an avian digestive track model that generally provides a gizzard digestion assay suitable for poultry industry. Similar to the mammalian PBET assay, "feed additive" enzymes can be assessed using an Avian PBET assay which provides an intestinal simulation model to capture the complexity of the avian digestive track using a dynamic avian gizzard-intestine system containing grit (Martinez-Haro et al., "Avian digestive tract simulation to study the effect of grit geochemistry and food on Pb shot bioaccessibility", Environmental Science and Technology 2009; 43: 9480-9486).

In view of the above, it will be seen that the several objects of the invention are achieved and other advantageous results attained.

As various changes could be made in the above products, formulations, and methods without departing from the scope of the invention, it is intended that all matter contained in the above description and shown in the accompanying drawings shall be interpreted as illustrative and not in a limiting sense.

EMBODIMENTS

For further illustration, additional non-limiting embodiments of the present disclosure are set forth below.

Embodiment 1 is a fusion protein comprising:
a targeting sequence, exosporium protein, or exosporium protein fragment that targets the fusion protein to the exosporium of a recombinant *Bacillus cereus* family member; and
an enzyme having 1-aminocyclopropane-1-carboxylate deaminase (ACC deaminase) activity, wherein the enzyme having ACC deaminase activity comprises:
an amino acid sequence comprising at least one amino acid substitution relative to the sequence of a wild-type D-cysteine desulfhydrase or ACC deaminase enzyme from a *Bacillus* genus bacterium, wherein the amino acid substitution results in increased ACC deaminase activity as compared to the ACC deaminase activity of the wild-type D-cysteine desulfhydrase or ACC deaminase enzyme under the same conditions;
a *Bacillus* enzyme;
an amino acid sequence having at least 70%, at least 75%, at least 80%, at least 85%, at least 90%, at least 95%, at least 98%, or at least 99% identity to any one of SEQ ID NOs. 242-245;
or a combination of any thereof.

Embodiment 2 is a fusion protein of embodiment 1, wherein the amino acid sequence of the enzyme comprises two amino acid substitutions relative to the sequence of the wild-type D-cysteine desulfhydrase or ACC deaminase enzyme, wherein the amino acid substitutions result in increased ACC deaminase activity as compared to the ACC deaminase activity of the wild-type enzyme under the same conditions.

Embodiment 3 is a fusion protein of embodiment 1 or 2, wherein the enzyme having ACC deaminase activity comprises a *Bacillus thuringiensis* enzyme or a *Bacillus pseudomycoides* enzyme.

Embodiment 4 is a fusion protein of any one of embodiments 1-3, wherein the amino acid sequence of the enzyme comprises:

a substitution of the threonine residue at position 290 of SEQ ID NO: 242 with a glutamic acid residue and a substitution of the serine residue at position 317 of SEQ ID NO: 242 with a leucine residue;
a substitution of the threonine residue at position 290 of SEQ ID NO: 243 with a glutamic acid residue and a substitution of the serine residue at position 317 of SEQ ID NO: 243 with a leucine residue;
a substitution of the threonine residue at position 290 of SEQ ID NO: 244 with a glutamic acid residue and a substitution of the serine residue at position 317 of SEQ ID NO: 244 with a leucine residue; or
a substitution of the threonine residue at position 290 of SEQ ID NO: 245 with a glutamic acid residue and a substitution of the serine residue at position 317 of SEQ ID NO: 245 with a leucine residue.

Embodiment 5 is a fusion protein of any one of embodiments 1-4, wherein the enzyme comprises or consists of SEQ ID NO: 246, 247, 248, or 249.

Embodiment 6 is a fusion protein of embodiment 5, wherein the enzyme comprises or consists of SEQ ID NO: 249.

Embodiment 7 is a fusion protein of embodiment 1, wherein the enzyme comprises an amino acid sequence having 100% identity to any one of SEQ ID NOs. 242-245.

Embodiment 8 is a fusion protein of embodiment 7, wherein the enzyme comprises or consists of SEQ ID NO: 245.

Embodiment 9 is a fusion protein comprising:
a targeting sequence, exosporium protein, or exosporium protein fragment that targets the fusion protein to the exosporium of a recombinant *Bacillus cereus* family member; and
a phospholipase, the phospholipase:
comprising a phospholipase B;
comprising a phospholipase C, the phospholipase C comprising a phospholipase C beta 1, a phospholipase C beta 2, a phospholipase C beta 3, a phospholipase C beta 4, a phospholipase C delta 1, a phospholipase C delta 3, a phospholipase C delta 4, a phospholipase C epsilon 1, a phospholipase C gamma 1, a phospholipase C gamma 2, a phospholipase C eta 1, a phospholipase C eta 2, a phospholipase C zeta 1, or a combination of any thereof;
comprising a phospholipase D, the phospholipase D comprising a phospholipase D1, a phospholipase D2, a phospholipase D member 3, a phospholipase D member 4, a phospholipase D member 5, a phospholipase D member 6, or a combination of any thereof;
comprising a phospholipase A2, the phospholipase A2 comprising a Group IIA phospholipase A2, a Group IIC phospholipase A2, a Group IID phospholipase A2, a Group IIE phospholipase A2, a Group IIF phospholipase A2, a Group III phospholipase A2, a Group IVA phospholipase A2, a Group IVB phospholipase A2, a Group IVC phospholipase A2, a Group IVD phospholipase A2, a Group IVE phospholipase A2, a Group VIF phospholipase A2, a Group V phospholipase A2, a Group VI phospholipase A2, a Group VII phospholipase A2, a Group X phospholipase A2, a Group XIIA phospholipase A2, a Group XIIB phospholipase A2, a Group XV phospholipase A2, a Group XVI phospholipase A2, or a combination of any thereof;

comprising a 1-alkyl-2-acetylglycerophosphocholine esterase;
comprising a phosphatidylinositol deacylase;
comprising a phosphatidylinoslitol-specific phospholipase C;
comprising a sphingomyelin phosphodiesterase;
comprising a sphingomyelin phosphodiesterase D;
comprising an alkylglycerophosphoethanolamine phosphodiesterase;
comprising a variant-surface-glycoprotein phospholipase C;
comprising a glycosylphosphatidylinositol phospholipase D;
comprising an N-acetylphosphatidylethanolamine-hydrolysing phospholipase D;
comprising a phosphatidylinositol diacylglycerol-lyase;
comprising a glycosylphosphatidylinositol diacylglycerol-lyase;
comprising a patatin-like phospholipase domain containing protein 2 (PNPLA2);
comprising a patatin-like phospholipase domain containing protein 3 (PNPLA3);
comprising a *Streptomyces* phospholipase;
comprising a *Clostridium* phospholipase;
comprising an *Acidovorax* phospholipase;
comprising *Listeria* phospholipase;
comprising a *Bacillus cereus* phospholipase;
comprising a *Bacillus licheniformis* phospholipase;
comprising an amino acid sequence having at least 70%, at least 75%, at least 80%, at least 85%, at least 90%, at least 95%, at least 98%, at least 99%, or 100% identity to any one of SEQ ID NOs. 252-260 and 373-375;
consisting essentially of an amino acid sequence having at least 70%, at least 75%, at least 80%, at least 85%, at least 90%, at least 95%, at least 98%, at least 99%, or 100% identity to SEQ ID NO: 250 or 251;
or a combination of any thereof.

Embodiment 10 is a fusion protein of embodiment 9, wherein phospholipase comprises a phospholipase B, the phospholipase B comprising a phospholipase B1.

Embodiment 11 is a fusion protein of embodiment 9, wherein the phospholipase comprises a *Streptomyces* phospholipase, the *Streptomyces* phospholipase comprising a *Streptomyces chromofuscus* phospholipase; wherein the phospholipase comprises a *Clostridium* phospholipase, the *Clostridium* phospholipase comprising a *Clostridium perfringens* phospholipase; or wherein the phospholipase comprises a *Listeria* phospholipase, the *Listeria* phospholipase comprising a *Listeria monocytogenes* phospholipase.

Embodiment 12 is a fusion protein of embodiment 11, wherein the *Streptomyces chromofuscus* phospholipase comprises *Streptomyces chromofuscus* phospholipase D, wherein the *Clostridium perfringens* phospholipase comprises *Clostridium perfringens* phospholipase C; or wherein the *Listeria monocytogenes* phospholipase comprises a *Listeria monocytogenes* phospholipase C.

Embodiment 13 is a fusion protein of embodiment 9, wherein the phospholipase comprises a *Bacillus cereus* phospholipase, the *Bacillus cereus* phospholipase comprising *Bacillus cereus* phosphatidylcholine-specific phospholipase C or a *Bacillus cereus* phosphatidylinositol-specific phospholipase C.

Embodiment 14 is a fusion protein of embodiment 9, wherein the phospholipase consists of an amino acid sequence having at least 70%, at least 75%, at least 80%, at least 85%, at least 90%, at least 95%, at least 98%, at least 99%, or 100% identity to SEQ ID NO: 250.

Embodiment 15 is a fusion protein of embodiment 9, wherein the phospholipase consists of an amino acid sequence having at least 70%, at least 75%, at least 80%, at least 85%, at least 90%, at least 95%, at least 98%, at least 99%, or 100% identity to SEQ ID NO: 251.

Embodiment 16 is a fusion protein of embodiment 9, wherein the phospholipase comprises an amino acid sequence having at least 70%, at least 75%, at least 80%, at least 85%, at least 90%, at least 95%, at least 98%, at least 99%, or 100% identity to SEQ ID NO: 256 or 260.

Embodiment 17 is a fusion protein of embodiment 16, wherein the phospholipase comprises an amino acid sequence having at least 70%, at least 75%, at least 80%, at least 85%, at least 90%, at least 95%, at least 98%, at least 99%, or 100% identity to SEQ ID NO: 256.

Embodiment 18 is a fusion protein of embodiment 9, wherein the phospholipase comprises phosphatidylinoslitol-specific phospholipase C and the phosphatidylinoslitol-specific phospholipase C comprises a *Bacillus thuringiensis* phosphatidylinoslitol-specific phospholipase C.

Embodiment 19 is a fusion protein of embodiment 9, wherein the phospholipase comprises an amino acid sequence having at least 70%, at least 75%, at least 80%, at least 85%, at least 90%, at least 95%, at least 98%, at least 99%, or 100% identity to any one of SEQ ID NOs. 373-375.

Embodiment 20 is a fusion protein comprising:
a targeting sequence, exosporium protein, or exosporium protein fragment that targets the fusion protein to the exosporium of a recombinant *Bacillus cereus* family member;
and
a lipase, the lipase comprising:
  a carboxyl ester lipase;
  a diacylglycerol lipase alpha;
  a diacylglycerol lipase beta;
  a lipase A;
  a hepatic lipase;
  a hormone-sensitive lipase;
  a gastric lipase;
  an endothelial lipase;
  a member H lipase;
  a lipase family member I;
  a lipase family member J;
  a lipase family member K;
  a lipase family member M;
  a lipase family member N;
  a lipoprotein lipase;
  a monoglyceride lipase;
  a pancreatic lipase-related protein 2;
  a pancreatic lipase-related protein 3;
  an acylglycerol lipase;
  a galactolipase;
  a lipoprotein lipase;
  a *Burkholderia cepacia* lipase;
  a *Burkholderia stearothermophilus* lipase;
  a *Pseudomonas* lipase;
  an amino acid sequence having at least 70%, at least 75%, at least 80%, at least 85%, at least 90%, at least 95%, at least 98%, at least 99%, or 100% identity to any one of SEQ ID NOs. 262-266;
or a combination of any thereof.

Embodiment 21 is a fusion protein comprising:
a targeting sequence, exosporium protein, or exosporium protein fragment that targets the fusion protein to the exosporium of a recombinant *Bacillus cereus* family member; and
a xylanase, the xylanase comprising:
  a beta-xylanase;
  a *Caldicellulosiruptor* xylanase;
  a *Bacillus* xylanase;
  a *Neocallimastix* xylanase;

a *Thermomyces* xylanase;

an amino acid sequence having at least 70%, at least 75%, at least 80%, at least 85%, at least 90%, at least 95%, at least 98%, at least 99%, or 100% identity to any one of SEQ ID NOs. 267-273;

or a combination of any thereof.

Embodiment 22 is a fusion protein of embodiment 21, wherein the xylanase comprises a beta-xylanase, the beta-xylanase comprising a glucuronoarabinoxylan endo-1,4-beta-xylanase, an exo-1,4-beta-xylanase, an endo-1,4-beta-xylanase, or a combination of any thereof.

Embodiment 23 is a fusion protein of embodiment 21 or 22, wherein the xylanase comprises a *Caldicellulosiruptor* xylanase, the *Caldicellulosiruptor* xylanase comprising a *Caldicellulosiruptor saccharolyticus* xylanase; wherein the xylanase comprises a *Bacillus* xylanase, the *Bacillus* xylanase comprising a *Bacillus subtilis* or *Bacillus stearothermophilus* xylanase; wherein the xylanase comprises a *Neocallimastix* xylanase, the *Neocallimastix* xylanase comprising a *Neocallimastix patriciarum* xylanase; or wherein the xylanase comprises a *Thermomyces* xylanase, the *Thermomyces* xylanase comprising a *Thermomyces lanuginosus* xylanase.

Embodiment 24 is a fusion protein of embodiment 21, wherein the xylanase comprises an amino acid sequence having at least 70%, at least 75%, at least 80%, at least 85%, at least 90%, at least 95%, at least 98%, at least 99%, or 100% identity to SEQ ID NO: 268 or 273.

Embodiment 25 is a fusion protein of embodiment 24, wherein the xylanase comprises an amino acid sequence having at least 70%, at least 75%, at least 80%, at least 85%, at least 90%, at least 95%, at least 98%, at least 99%, or 100% identity to SEQ ID NO: 268.

Embodiment 26 is a fusion protein comprising:

a targeting sequence, exosporium protein, or exosporium protein fragment that targets the fusion protein to the exosporium of a recombinant *Bacillus cereus* family member; and a xylosidase, the xylosidase comprising:

a *Caldicellulosiruptor saccharolyticus* xylosidase;

a *Bacillus pumilus* xylosidase;

a *Bacillus subtilis* xylosidase;

an amino acid sequence having at least 70%, at least 75%, at least 80%, at least 85%, at least 90%, at least 95%, at least 98%, at least 99%, or 100% identity to any one of SEQ ID NOs. 274-276;

or a combination thereof.

Embodiment 27 is a fusion protein of embodiment 26, wherein the xylosidase comprises an amino acid sequence having at least 70%, at least 75%, at least 80%, at least 85%, at least 90%, at least 95%, at least 98%, at least 99%, or 100% identity to SEQ ID NO: 275.

Embodiment 28 is a fusion protein of embodiment 26, wherein the xylosidase comprises an amino acid sequence having at least 70%, at least 75%, at least 80%, at least 85%, at least 90%, at least 95%, at least 98%, at least 99%, or 100% identity to SEQ ID NO: 276.

Embodiment 29 is a fusion protein comprising:

a targeting sequence, exosporium protein, or exosporium protein fragment that targets the fusion protein to the exosporium of a recombinant *Bacillus cereus* family member; and a lactonase, the lactonase comprising:

a *Bacillus* lactonase;

an *Agrobacterium* lactonase;

a *Rhodococcus* lactonase;

a *Streptomyces* lactonase;

an *Arthrobacter* lactonase;

a *Sphingomonas* lactonase;

a *Pseudomonas* lactonase;

a *Klebsiella* lactonase;

an amino acid sequence having at least 70%, at least 75%, at least 80%, at least 85%, at least 90%, at least 95%, at least 98%, at least 99%, or 100% identity to SEQ ID NO: 277 or 278;

or a combination of any thereof.

Embodiment 30 is a fusion protein of embodiment 29, wherein the lactonase comprises an *Agrobacterium* lactonase, a *Rhodococcus* lactonase, a *Streptomyces* lactonase, an *Arthrobacter* lactonase, a *Sphingomonas* lactonase, a *Pseudomonas* lactonase, a *Klebsiella* lactonase, or a combination of any thereof.

Embodiment 31 is a fusion protein of embodiment 29, wherein the lactonase comprises a *Bacillus* lactonase, the *Bacillus* lactonase comprising a *Bacillus thuringiensis* lactonase, a *Bacillus pseudomycoides* lactonase, or a combination thereof.

Embodiment 32 is a fusion protein of embodiment 31, wherein the lactonase comprises an AiiA lactonase.

Embodiment 33 is a fusion protein of any one of embodiments 29-32, wherein the lactonase is specific for a bacterial lactone homoserine signaling molecule.

Embodiment 34 is a fusion protein comprising:

a targeting sequence, exosporium protein, or exosporium protein fragment that targets the fusion protein to the exosporium of a recombinant *Bacillus cereus* family member; and a chitosanase, the chitosanase:

comprising an exo-1,4-beta-D-glucosaminidase;

comprising an endo-1,4-beta-d-glucosaminidase;

comprising a *Streptomyces* chitosanase;

comprising an amino acid sequence having at least 70%, at least 75%, at least 80%, at least 85%, at least 90%, at least 95%, at least 98%, at least 99%, or 100% identity to SEQ ID NO: 280;

consisting essentially of an amino acid sequence having at least 70%, at least 75%, at least 80%, at least 85%, at least 90%, at least 95%, at least 98%, at least 99%, or 100% identity to SEQ ID NO: 279;

or a combination of any thereof.

Embodiment 35 is a fusion protein of embodiment 34, wherein the chitosanase consists of an amino acid sequence having at least 70%, at least 75%, at least 80%, at least 85%, at least 90%, at least 95%, at least 98%, at least 99%, or 100% identity to SEQ ID NO: 279.

Embodiment 36 is a fusion protein of embodiment 34, wherein the chitosanase comprises an amino acid sequence having 100% identity to SEQ ID NO: 280.

Embodiment 37 is a fusion protein comprising:

a targeting sequence, exosporium protein, or exosporium protein fragment that targets the fusion protein to the exosporium of a recombinant *Bacillus cereus* family member; and a protease, the protease comprising:
an asparagine protease;
a *Bacillus* protease;
an *Aspergillus* protease;
an amino acid sequence having at least 70%, at least 75%, at least 80%, at least 85%, at least 90%, at least 95%, at least 98%, at least 99%, or 100% identity to any one of SEQ ID NOs. 303-306;

or a combination of any thereof.

Embodiment 38 is a fusion protein of embodiment 37, wherein the protease does not consist of a methionine aminopeptidase.

Embodiment 39 is a fusion protein of embodiment 37 or 38, wherein the protease does not comprise a methionine aminopeptidase.

Embodiment 40 is a fusion protein of any one of embodiments 37-39, wherein the protease comprises an *Aspergillus* protease.

Embodiment 41 is a fusion protein of any one of embodiments 37-39, wherein the protease comprises a *Bacillus* protease, the *Bacillus* protease comprising a *Bacillus subtilis* protease.

Embodiment 42 is a fusion protein of any one of embodiments 37-39, wherein the protease comprises an amino acid sequence having at least 70%, at least 75%, at least 80%, at least 85%, at least 90%, at least 95%, at least 98%, at least 99%, or 100% identity to SEQ ID NO: 305 or 306.

Embodiment 43 is a fusion protein of any one of embodiments 37-39, wherein the protease comprises an amino acid sequence having 100% identity to SEQ ID NO: 304.

Embodiment 44 is a fusion protein comprising:

a targeting sequence, exosporium protein, or exosporium protein fragment that targets the fusion protein to the exosporium of a recombinant *Bacillus cereus* family member; and a glucanase, the glucanase:

comprising an alpha-1,6-glucanase;

comprising a beta 1,3/1,4 glucanase;

comprising a xyloglucan:xyloglucosyl transferase;

comprising a cycloheptaglucanase;

comprising an oligoxyloglucan beta-glycosidase;

comprising a cyclohexaglucanase;

comprising a xyloglucanase;

comprising a cellulose 1,4-beta-cellobiosidase;

comprising a glucan endo-1,3-beta-D-glucosidase;

comprising a cyclomaltodextrinase;

comprising a glucan 1,3-beta-glucosidase;

comprising a glucan endo-1,3-alpha-glucosidase;

comprising an endo-1,3(4)-beta-glucanase;

comprising a lichenase;

comprising a laminarinase;

comprising a glucan 1,4-beta-glucosidase;

comprising a glucan endo-1,6-beta-glucosidase;

comprising a glucan 1,3-alpha-glucosidase;

comprising an amylopectinase;

comprising an amyloglucanase;

comprising an amyloglucosidase;

comprising an *Acidothermus* glucanase;

comprising an *Aspergillus* glucanase;

comprising a *Paenibacillus* glucanase;

comprising a *Helix* glucanase;

comprising a *Bacillus circulans* glucanase;

comprising a *Bacillus lichenformis* glucanase;

comprising a *Clostridium* glucanase;

comprising a *Trichoderma reesei* beta-1,4-endoglucanase;

comprising a *Bacillus subtilis* amylase;

comprising an amino acid sequence having at least 70%, at least 75%, at least 80%, at least 85%, at least 90%, at least 95%, at least 98%, at least 99%, or 100% identity to any one of SEQ ID NOs. 281-292 and 295-302;

consisting essentially of an amino acid sequence having at least 70%, at least 75%, at least 80%, at least 85%, at least 90%, at least 95%, at least 98%, at least 99%, or 100% identity to SEQ ID NO: 293 or 294;

or a combination of any thereof.

Embodiment 45 is a fusion protein of embodiment 44, wherein the glucanase comprises an *Acidothermus* glucanase, an *Aspergillus* glucanase, a *Paenibacillus* glucanase, a *Helix* glucanase, a *Bacillus lichenformis* glucanase, a *Clostridium* glucanase, a *Trichoderma reesei* beta-1,4-endoglucanase, a *Bacillus subtilis* amylase, or a combination of any thereof.

Embodiment 46 is a fusion protein of embodiment 44 or 45, wherein the glucanase comprises a *Helix* glucanase, the *Helix* glucanase comprising a *Helix pomatia* glucanase; wherein the glucanase comprises an *Acidothermus* glucanase, the *Acidothermus* glucanase comprising an *Acidothermus cellulolyticus* glucanase; wherein the glucanase comprises a *Clostridium* glucanase, the *Clostridium* glucanase comprising a *Clostridium thermocellum* glucanase; or a combination of any thereof.

Embodiment 47 is a fusion protein of embodiment 46, wherein the *Helix pomatia* glucanase comprises a *Helix pomatia* beta-1,3-endoglucanase; or wherein the *Acidothermus* glucanase comprises an *Acidothermus cellulolyticus* beta-1,4 endoglucanase.

Embodiment 48 is a fusion protein of any one of embodiments 44-46, wherein the glucanase comprises a xyloglucanase.

Embodiment 49 is a fusion protein of embodiment 48, wherein the xyloglucanase comprises a xyloglucan-specific endo-beta-1,4-glucanase, a xyloglucan-specific exo-beta-1,4-glucanase, or a combination thereof.

Embodiment 50 is a fusion protein of embodiment 48 or 49, wherein the xyloglucanase comprises a *Paenibacillus* xyloglucanase or a *Bacillus* xyloglucanase.

Embodiment 51 is a fusion protein of embodiment 50, wherein the *Bacillus* xyloglucanase comprises a *Bacillus lichenformis* xyloglucanase.

Embodiment 52 is a fusion protein of embodiment 50, wherein the *Paenibacillus* xyloglucanase comprises a *Paenibacillus pabuli* xyloglucanase.

Embodiment 53 is a fusion protein of any one of embodiments 44-46, wherein the glucanase comprises a lichenase.

Embodiment 54 is a fusion protein of embodiment 53, wherein the lichenase comprises a *Bacillus subtilis* lichenase or a *Clostridium thermocellum* lichenase.

Embodiment 55 is a fusion protein of any one of embodiments 44-46, wherein the glucanase comprises the *Bacillus subtilis* amylase.

Embodiment 56 is a fusion protein of any one of embodiments 44-55, wherein the glucanase comprises an amino acid sequence having at least 70%, at least 75%, at least 80%, at least 85%, at least 90%, at least 95%, at least 98%, at least 99%, or 100% identity to any one of SEQ ID NOs. 281-292, 295-296 and 298-302.

Embodiment 57 is a fusion protein of any one of embodiments 44-55, wherein the glucanase comprises an amino acid sequence having at least 70%, at least 75%, at least 80%, at least 85%, at least 90%, at least 95%, at least 98%, at least 99%, or 100% identity to SEQ ID NO: 299 or 300.

Embodiment 58 is a fusion protein of any one of embodiments 44-55, wherein the glucanase consists of an amino acid sequence having at least 70%, at least 75%, at least 80%, at least 85%, at least 90%, at least 95%, at least 98%, at least 99%, or 100% identity to SEQ ID NO: 293 or 294.

Embodiment 59 is a fusion protein comprising:
a targeting sequence, exosporium protein, or exosporium protein fragment that targets the fusion protein to the exosporium of a recombinant *Bacillus cereus* family member; and
an expansin protein, the expansin protein comprising an amino acid sequence having at least 70%, at least 75%, at least 80%, at least 85%, at least 90%, at least 95%, at least 98%, at least 99%, or 100% identity to SEQ ID NO: 316.

Embodiment 60 is a fusion protein comprising:
a targeting sequence, exosporium protein, or exosporium protein fragment that targets the fusion protein to the exosporium of a recombinant *Bacillus cereus* family member; and
a phytase, the phytase comprising:
  a *Triticum* phytase;
  a *Bacillus* phytase;
  an amino acid sequence having at least 70%, at least 75%, at least 80%, at least 85%, at least 90%, at least 95%, at least 98%, at least 99%, or 100% identity to any one of SEQ ID NOs. 313-315 and 380;
or a combination thereof.

Embodiment 61 is a fusion protein of embodiment 60, wherein the phytase comprises a *Triticum* phytase, the *Triticum* phytase comprising a *Triticum aestivum* phytase phytase; or wherein the phytase comprises a *Bacillus* phytase, the *Bacillus* phytase comprising a *Bacillus thuringiensis* phytase.

Embodiment 62 is a fusion protein of embodiment 60 or 61, wherein the phytase comprises an amino acid sequence having at least 70%, at least 75%, at least 80%, at least 85%, at least 90%, at least 95%, at least 98%, at least 99%, or 100% identity to SEQ ID NO: 380.

Embodiment 63 is a fusion protein comprising:
a targeting sequence, exosporium protein, or exosporium protein fragment that targets the fusion protein to the exosporium of a recombinant *Bacillus cereus* family member; and
an acid phosphatase, the acid phosphatase comprising:
  a *Triticum* acid phosphatase;
  a *Bacillus* acid phosphatase;
  an amino acid sequence having at least 70%, at least 75%, at least 80%, at least 85%, at least 90%, at least 95%, at least 98%, at least 99%, or 100% identity to any one of SEQ ID NOs, 311, 312, and 378;
or a combination thereof.

Embodiment 64 is a fusion protein of embodiment 63, wherein the acid phosphatase comprises a *Triticum* acid phosphatase, the *Triticum* acid phosphatase comprising a *Triticum aestivum* acid phosphatase; or wherein the acid phosphatase comprises a *Bacillus* acid phosphatase, the *Bacillus* acid phosphatase comprising a *Bacillus thuringiensis* acid phosphatase.

Embodiment 65 is a fusion protein of embodiment 63 or 64, wherein the acid phosphatase comprises an amino acid sequence having at least 70%, at least 75%, at least 80%, at least 85%, at least 90%, at least 95%, at least 98%, at least 99%, or 100% identity to SEQ ID NO: 311.

Embodiment 66 is a fusion protein of embodiment 63 or 64, wherein the acid phosphatase comprises an amino acid sequence having at least 70%, at least 75%, at least 80%, at least 85%, at least 90%, at least 95%, at least 98%, at least 99%, or 100% identity to SEQ ID NO: 312.

Embodiment 67 is a fusion protein of embodiment 63 or 64, wherein the acid phosphatase comprises an amino acid sequence having at least 70%, at least 75%, at least 80%, at least 85%, at least 90%, at least 95%, at least 98%, at least 99%, or 100% identity to SEQ ID NO: 378.

Embodiment 68 is a fusion protein comprising:
a targeting sequence, exosporium protein, or exosporium protein fragment that targets the fusion protein to the exosporium of a recombinant *Bacillus cereus* family member; and
a pectinase, the pectinase comprising a pectolyase.

Embodiment 69 is a fusion protein of embodiment 68, wherein the pectolyase comprises an *Aspergillus* pectolyase or a *Bacillus* pectolyase.

Embodiment 70 is a fusion protein of embodiment 68 or 69, wherein the pectolyase comprises an amino acid sequence having at least 70%, at least 75%, at least 80%, at least 85%, at least 90%, at least 95%, at least 98%, at least 99%, or 100% identity to SEQ ID NO: 309 or 310.

Embodiment 71 is a fusion protein comprising:
a targeting sequence, exosporium protein, or exosporium protein fragment that targets the fusion protein to the exosporium of a recombinant *Bacillus cereus* family member; and
a mannanase.

Embodiment 72 is a fusion protein of embodiment 71, wherein the fusion protein comprises a *Bacillus* mannanase.

Embodiment 73 is a fusion protein of embodiment 71 or 72, wherein mannanase comprises an amino acid sequence having at least 70%, at least 75%, at least 80%, at least 85%, at least 90%, at least 95%, at least 98%, at least 99%, or 100% identity to SEQ ID NO: 307 or 308.

Embodiment 74 is a recombinant *Bacillus cereus* family member that expresses a fusion protein of any one of embodiments 1-73.

Embodiment 75 is exosporium fragments derived from a recombinant *Bacillus cereus* family member of embodiment 74.

Embodiment 76 is a formulation comprising a recombinant *Bacillus cereus* family member of embodiment 74 and an agriculturally acceptable carrier.

Embodiment 77 is a formulation comprising exosporium fragments of embodiment 75 and an agriculturally acceptable carrier.

Embodiment 78 is a formulation of embodiment 76 or 77, wherein the fusion protein comprises a *Bacillus cereus* phosphatidylcholine-specific phospholipase C and the formulation further comprises a mannanase or a xyloglucanase.

Embodiment 79 is a formulation of embodiment 76 or 77, wherein the fusion protein comprises a mannanase and the formulation further comprises a *Bacillus cereus* phosphatidylcholine-specific phospholipase C.

Embodiment 80 is a formulation of embodiment 76 or 77, wherein the fusion protein comprises a xyloglucanase and the formulation further comprises a *Bacillus cereus* phosphatidylcholine-specific phospholipase C.

Embodiment 81 is a formulation of embodiment 76 or 77, wherein the fusion protein comprises a xyloglucanase and the formulation further comprises a mannanase.

Embodiment 82 is a formulation of embodiment 76 or 77, wherein the fusion protein comprises a mannanase and the formulation further comprises a xyloglucanase.

Embodiment 83 is a formulation of embodiment 76 or 77, wherein the fusion protein comprises an acid phosphatase comprising SEQ ID NO: 311, and wherein the formulation further comprises an acid phosphatase comprising SEQ ID NO: 312.

Embodiment 84 is a formulation of embodiment 76 or 77, wherein the fusion protein comprises an acid phosphatase comprising SEQ ID NO: 312, and wherein the formulation further comprises an acid phosphatase comprising SEQ ID NO: 311.

Embodiment 85 is a formulation comprising a recombinant *Bacillus cereus* family member that expresses a fusion protein or exosporium fragments derived from a *Bacillus cereus* family member that expresses a fusion protein, wherein the fusion protein comprises:
a targeting sequence, exosporium protein, or exosporium protein fragment that targets the fusion protein to the exosporium of a recombinant *Bacillus cereus* family member; and
an acid phosphatase;
and wherein the formulation further comprises a second enzyme.

Embodiment 86 is a formulation comprising a recombinant *Bacillus cereus* family member that expresses a fusion protein or exosporium fragments derived from a *Bacillus cereus* family member that expresses a fusion protein, wherein the fusion protein comprises:
a targeting sequence, exosporium protein, or exosporium protein fragment that targets the fusion protein to the exosporium of a recombinant *Bacillus cereus* family member; and
a phospholipase C;
and wherein the formulation further comprises a second enzyme.

Embodiment 87 is a formulation of any one of embodiments 76-86, wherein the formulation further comprises agrochemical.

Embodiment 88 is a formulation of any one of embodiments 76-87, wherein the formulation further comprises a fertilizer, a biostimulant, or a combination thereof.

Embodiment 89 is a plant seed treated with a recombinant *Bacillus cereus* family member of embodiment 74.

Embodiment 90 is a plant seed treated with exosporium fragments of embodiment 75.

Embodiment 91 is a plant seed treated with a formulation of any one of embodiments 76-88.

Embodiment 92 is a plant seed of any one of embodiments 89-91, wherein the plant seed is coated with the recombinant *Bacillus cereus* family member, the exosporium fragments, or the formulation.

Embodiment 93 is an animal feed additive comprising a recombinant *Bacillus cereus* family member of embodiment 74.

Embodiment 94 is an animal feed additive comprising exosporium fragments of embodiment 75.

Embodiment 95 is an animal feed composition comprising animal feed and a recombinant *Bacillus cereus* family member of embodiment 74.

Embodiment 96 is an animal feed composition comprising animal feed and exosporium fragments of embodiment 75.

Embodiment 97 is an animal feed additive of embodiment 93 or 94 or an animal feed composition of embodiment 95 or 96, wherein the additive or composition further comprises a carrier suitable for injection by a livestock or companion animal.

Embodiment 98 is an animal feed additive or animal feed composition of embodiment 97, wherein the carrier comprises starch, polyvinyl alcohol, a dextrin, limestone, sucrose, talc, cellulose, or a combination of any thereof.

Embodiment 99 is an animal feed additive or animal feed composition of embodiment 98, wherein the dextrin comprises maltodextrin, cyclodextrin, or a combination thereof.

Embodiment 100 is an animal feed additive or animal feed composition of embodiment 98 or 99, wherein the carrier comprises polyvinyl alcohol and cellulose.

Embodiment 101 is an animal feed composition of any one of embodiments 95-100, wherein the animal feed comprises fodder.

Embodiment 102 is an animal feed composition of embodiment 101, wherein the fodder comprises hay, straw, silage, a compressed feed, a pelleted feed, an oil, a grain, a sprouted grain, a legume, an insoluble fraction of a feedcrop, crop residue, or a combination of any thereof.

Embodiment 103 is an animal feed composition of embodiment 102, wherein the legume comprises soybean.

Embodiment 104 is an animal feed composition of embodiment 102, wherein the insoluble fraction of a feedcrop comprises corn stalks.

Embodiment 105 is an animal feed composition of any one of embodiments 95-104, wherein the animal feed comprises a cereal.

Embodiment 106 is an animal feed composition of embodiment 105, wherein the cereal comprises barley, wheat, rye, oats, corn, rice, millet, sorghum, or a combination of any thereof.

Embodiment 107 is a method for stimulating plant growth and/or promoting plant health, comprising applying a recombinant *Bacillus cereus* family member of embodiment 74, exosporium fragments of embodiment 75, or a formulation of any one of embodiments 76-88 to a plant growth medium, a plant, a plant seed, or an area surrounding a plant or a plant seed.

Embodiment 108 is a method of embodiment 107, wherein the method comprises applying a recombinant *Bacillus cereus* family member of embodiment 74.

Embodiment 109 is a method of embodiment 107, wherein the method comprises applying exosporium fragments of embodiment 75.

Embodiment 110 is a method of embodiment 107, wherein the method comprises applying a formulation of any one of embodiments 76-88.

Embodiment 111 is a method of any one of embodiments 107-110, wherein the fusion protein comprises a *Bacillus cereus* phosphatidylcholine-specific phospholipase C and the method further comprises applying a mannanase or a xyloglucanase to the plant growth medium, plant, plant seed, or area surrounding the plant or the plant seed.

Embodiment 112 is a method of any one of embodiments 107-110, wherein the fusion protein comprises a mannanase and the method further comprises applying a *Bacillus cereus* phosphatidylcholine-specific phospholipase C to the plant growth medium, plant, plant seed, or area surrounding the plant or the plant seed.

Embodiment 113 is a method of any one of embodiments 107-110, wherein the fusion protein comprises a xyloglucanase and the method further comprises applying a *Bacillus cereus* phosphatidylcholine-specific phospholipase C to the plant growth medium, plant, plant seed, or area surrounding the plant or the plant seed.

Embodiment 114 is a formulation of any one of embodiments 78, 79, 87, and 88, a seed of embodiment 84 or 85, or a method of embodiment 111 or 112, wherein the phospholipase C and the mannanase are present in synergistically effective amounts.

Embodiment 115 is a formulation of any one of embodiments 78, 80, 87, and 88, a seed of embodiment 91 or 92, or a method of embodiment 111 or 113, wherein the phospholipase C and the xyloglucanase are present in synergistically effective amounts.

Embodiment 116 is a method of any one of embodiments 107-110, wherein the fusion protein comprises a xyloglucanase and the method further comprises applying a mannanase to the plant growth medium, plant, plant seed, or area surrounding the plant or the plant seed.

Embodiment 117 is a method of any one of embodiments 107-110, wherein the fusion protein comprises a mannanase and the method further comprises applying a xyloglucanase to the plant growth medium, plant, plant seed, or area surrounding the plant or the plant seed.

Embodiment 118 is a formulation of any one of embodiments 81, 82, 87, and 88, a seed of embodiment 91 or 92, or a method of embodiment 116 or 117, wherein the xyloglucanase and the mannanase are present in synergistically effective amounts.

Embodiment 119 is a method of any one of embodiments 107-110, wherein the fusion protein comprises an acid phosphatase comprising SEQ ID NO: 311, and wherein the method further comprises applying an acid phosphatase comprising SEQ ID NO: 312 to the plant growth medium, plant, plant seed, or area surrounding the plant or the plant seed.

Embodiment 120 is a method of any one of embodiments 107-110, wherein the fusion protein comprises an acid phosphatase comprising SEQ ID NO: 312, and wherein the method further comprises applying an acid phosphatase comprising SEQ ID NO: 311 to the plant growth medium, plant, plant seed, or area surrounding the plant or the plant seed.

Embodiment 121 is a method for stimulating plant growth and/or promoting plant health, comprising applying a recombinant *Bacillus cereus* family member expressing a fusion protein to a plant growth medium, a plant, a plant seed, or an area surrounding a plant or a plant seed, wherein the fusion protein comprises:

a targeting sequence, exosporium protein, or exosporium protein fragment that targets the fusion protein to the exosporium of a recombinant *Bacillus cereus* family member;

and a xylosidase, a histidine protease, an acid phosphatase, or a combination of any thereof.

Embodiment 122 is a method for stimulating plant growth and/or promoting plant health, comprising applying exosporium fragments derived from spores of a recombinant *Bacillus cereus* family member expressing a fusion protein to a plant growth medium, a plant, a plant seed, or an area surrounding a plant or a plant seed, wherein the fusion protein comprises:

a targeting sequence, exosporium protein, or exosporium protein fragment that targets the fusion protein to the exosporium of a recombinant *Bacillus cereus* family member; and a xylosidase, a histidine protease, an acid phosphatase, or a combination of any thereof.

Embodiment 123 is a method of embodiment 121 or 122, wherein the fusion protein comprises a xylosidase.

Embodiment 124 is a method of embodiment 123, wherein the xylosidase comprises a *Caldicellulosiruptor saccharolyticus* xylosidase, a *Bacillus pumilus* xylosidase, *Bacillus subtilis* xylosidase, or a combination thereof.

Embodiment 125 is a method of embodiment 123 or 124, wherein the xylosidase comprises an amino acid sequence having at least 70%, at least 75%, at least 80%, at least 85%, at least 90%, at least 95%, at least 98%, at least 99%, or 100% identity to any one of SEQ ID NOs. 274-276.

Embodiment 126 is a method of embodiment 121 or 122, wherein the fusion protein comprises a histidine protease.

Embodiment 127 is a method of embodiment 121 or 122, wherein the fusion protein comprises an acid phosphatase.

Embodiment 128 is a method for stimulating plant growth and/or promoting plant health, comprising applying a recombinant *Bacillus cereus* family member expressing a fusion protein to a plant growth medium, a plant, a plant seed, or an area surrounding a plant or a plant seed, wherein the fusion protein comprises:

a targeting sequence, exosporium protein, or exosporium protein fragment that targets the fusion protein to the exosporium of a recombinant *Bacillus cereus* family member; and an acid phosphatase;

and wherein the method further comprises applying a second enzyme to the plant growth medium, the plant, the plant seed, or the area surrounding the plant or the plant seed.

Embodiment 129 is a method for stimulating plant growth and/or promoting plant health, comprising applying exosporium fragments derived from spores of a recombinant *Bacillus cereus* expressing a fusion protein to a plant growth medium, a plant, a plant seed, or an area surrounding a plant or a plant seed, wherein the fusion protein comprises:

a targeting sequence, exosporium protein, or exosporium protein fragment that targets the fusion protein to the exosporium of a recombinant *Bacillus cereus* family member; and an acid phosphatase;
and wherein the method further comprises applying a second enzyme to the plant growth medium, the plant, the plant seed, or the area surrounding the plant or the plant seed.

Embodiment 130 is a formulation of any one of embodiments 85-88, a seed of any one of embodiments 89-92, or a method of embodiment 128 or 129, wherein the second enzyme comprises a lipase, a phospholipase, a glucanase, a xylanase, a pectinase, a mannanase, a lichenase, or a combination of any thereof.

Embodiment 131 is a formulation of any one of embodiments 85-88 and 130, a seed of any one of embodiment 89-92 and 130, or a method of any one of embodiments 121, 122, and 127-130, wherein the acid phosphatase comprises a *Triticum aestivum* acid phosphatase.

Embodiment 132 is a formulation of any one of embodiments 85-88, 130, and 131, a seed of any one of embodiments 89-92, 130, and 131, or a method of any one of embodiments 121, 122, and 127-131, wherein the acid phosphatase comprises an amino acid sequence having at least 70%, at least 75%, at least 80%, at least 85%, at least 90%, at least 95%, at least 98%, at least 99%, or 100% identity to SEQ ID NO: 311 or 312.

Embodiment 133 is a method for stimulating plant growth and/or promoting plant health, comprising applying a recombinant *Bacillus cereus* family member expressing a fusion protein to a plant growth medium, a plant, a plant seed, or an area surrounding a plant or a plant seed, wherein the fusion protein comprises:

a targeting sequence, exosporium protein, or exosporium protein fragment that targets the fusion protein to the exosporium of a recombinant *Bacillus cereus* family member; and a phospholipase C;

and wherein the method further comprises applying a second enzyme to the plant growth medium, the plant, the plant seed, or the area surrounding the plant or the plant seed.

Embodiment 134 is a method for stimulating plant growth and/or promoting plant health, comprising applying exosporium fragments derived from spores of a recombinant *Bacillus cereus* expressing a fusion protein to a plant growth medium, a plant, a plant seed, or an area surrounding a plant or a plant seed, wherein the fusion protein comprises:

a targeting sequence, exosporium protein, or exosporium protein fragment that targets the fusion protein to the exosporium of a recombinant *Bacillus cereus* family member; and a phospholipase C;

and wherein the method further comprises applying a second enzyme to the plant growth medium, the plant, the plant seed, or the area surrounding the plant or the plant seed.

Embodiment 135 is a formulation of embodiment 86-88 or a method of embodiment 133 or 134, wherein the phospholipase C comprises a *Bacillus thuringiensis* phospholipase C.

Embodiment 136 is a formulation of embodiment 86-88 or 135 or a method of any one of embodiments 133-135, wherein the phospholipase C comprises an amino acid sequence having at least 70%, at least 75%, at least 80%, at least 85%, at least 90%, at least 95%, at least 98%, at least 99%, or 100% identity to SEQ ID NO: 250 or SEQ ID NO: 251.

Embodiment 137 is a formulation or method of embodiment 136, wherein the phospholipase C consists essentially of or consists of SEQ ID NO: 250 or SEQ ID NO: 251.

Embodiment 138 is a formulation of any one of embodiments 86-88 and 135-137 or a method of any one of embodiments 133-137, wherein the second enzyme comprises a xyloglucanase or a mannanase.

Embodiment 139 is a formulation or method of embodiment 138, wherein the second enzyme comprises a xyloglucanase and the xyloglucanase comprises a *Paenibacillus pabuli* xyloglucanase or a *Bacillus licheniformis* xyloglucanase.

Embodiment 140 is a formulation or method of embodiment 138 or 139, wherein the second enzyme comprises a xyloglucanase and the xyloglucanase comprises an amino acid sequence having at least 70%, at least 75%, at least 80%, at least 85%, at least 90%, at least 95%, at least 98%, at least 99%, or 100% identity to SEQ ID NO: 299 or 300.

Embodiment 141 is a formulation or method of embodiment 140, wherein the phospholipase C comprises SEQ ID NO: 250 and the xyloglucanase comprises SEQ ID NO: 299.

Embodiment 142 is a formulation or method of embodiment 140, wherein the phospholipase C comprises SEQ ID NO: 250 and the xyloglucanase comprises SEQ ID NO: 300.

Embodiment 143 is a formulation or method of any one of embodiments 138-142 or a seed of embodiment 91 or 92, wherein the phospholipase C and the xyloglucanase are present in synergistically effective amounts.

Embodiment 144 is a formulation or method of embodiment 138, wherein the second enzyme comprises a mannanase and the mannanase comprises a *Bacillus circulans* mannanase or a *Bacillus subtilis* mannanase.

Embodiment 145 is a formulation or method of embodiment 138 or 144, wherein the second enzyme comprises a mannanase and the mannanase comprises an amino acid sequence having at least 70%, at least 75%, at least 80%, at least 85%, at least 90%, at least 95%, at least 98%, at least 99%, or 100% identity to SEQ ID NO: 307 or 308.

Embodiment 146 is a formulation or method of embodiment 145, wherein the phospholipase C comprises SEQ ID NO: 250 and the mannanase comprises SEQ ID NO: 308.

Embodiment 147 is a formulation or method of embodiment 145, wherein the phospholipase C comprises SEQ ID NO: 250 and the mannanase comprises SEQ ID NO: 307.

Embodiment 148 is a formulation or method of any one of embodiments 144-147 or a seed of embodiment 91 or 92, wherein the phospholipase C and the mannanase are present in synergistically effective amounts.

Embodiment 149 is a method of any one of embodiments 107-132, wherein the method comprises applying the recombinant *Bacillus cereus* family member, the exosporium fragments, or the formulation to the plant growth medium.

Embodiment 150 is a method of embodiment 149, wherein the plant growth medium comprises a fertilizer.

Embodiment 151 is a method of embodiment 149, wherein the plant growth medium consists essentially of a fertilizer.

Embodiment 152 is a method of any one of embodiments 107-151, wherein the method further comprises supplementing the plant growth medium with a substrate for an enzyme.

Embodiment 153 is a method of embodiment 152, wherein the substrate comprises tryptophan, an adenosine monophosphate, an adenosine diphosphate, an adenosine triphosphate (e.g., adenosine-3-triphosphate), a polyphosphate, a protein meal, a trimetaphosphate, a cellulose, a methylcellulose, a chitin, a chitosan, a cellulose derivative, a phosphate, a fat, a wax, a phospholipid, a phytic acid, or a combination of any thereof.

Embodiment 154 is a method of any one of embodiments 107-153, wherein the method comprises applying the recombinant *Bacillus cereus* family member, the exosporium fragments, or the formulation to the plant.

Embodiment 155 is a method of embodiment 154, wherein the method comprises applying the recombinant *Bacillus cereus* family member, the exosporium fragments, or the formulation to roots of the plant.

Embodiment 156 is a method of embodiment 154 or 155, wherein the method comprises applying the recombinant *Bacillus cereus* family member, the exosporium fragments, or the formulation foliarly.

Embodiment 157 is a method of any one of embodiments 107-156, wherein the method comprises applying the recombinant *Bacillus cereus* family member, the exosporium fragments, or the formulation to the plant seed.

Embodiment 158 is a method of embodiment 157, wherein applying the recombinant *Bacillus cereus* family member, the exosporium fragments, or the formulation to the plant seed comprises:
(a) applying recombinant *Bacillus cereus* family member, the exosporium fragments, or the formulation to the plant seed at the time of planting; or
(b) coating the plant seed with the recombinant *Bacillus cereus* family member, the exosporium fragments, or the formulation.

Embodiment 159 is a method of any one of embodiments 107-158, wherein the method further comprises applying an agrochemical to the plant growth medium, the plant, the plant seed, or the area surrounding the plant or the plant seed.

Embodiment 160 is a method of any one of embodiments 107-159, wherein the method further comprises applying a fertilizer, a biostimulant, or a combination thereof to the plant growth medium, the plant, the plant seed, or the area surrounding the plant or the plant seed.

Embodiment 161 is a method of any one of embodiments 107-160, wherein plants grown in the presence of the recombinant *Bacillus cereus* family member, the exosporium fragments, or the formulation exhibit increased growth as compared to plants grown in the absence of the enzyme, the expansin protein, or the microorganism, under the same conditions.

Embodiment 162 is a method of any one of embodiments 107-161, wherein seeds to which the recombinant *Bacillus cereus* family member, the exosporium fragments, or the formulation has been applied exhibit increased germination rates as compared to seeds to which the enzyme or microorganism has not been applied, under the same conditions.

Embodiment 163 is a method of any one of embodiments 107-162, wherein plants grown in the presence of the recombinant *Bacillus cereus* family member, the exosporium fragments, or the formulation exhibit increased nutrient uptake as compared to plants grown in the absence of the enzyme, the expansin protein, or the microorganism, under the same conditions.

Embodiment 164 is a method of any one of embodiments 107-163, wherein plants grown in the presence of the recombinant *Bacillus cereus* family member, the exosporium fragments, or the formulation exhibit decreased susceptibility to a pathogen as compared to plants grown in the absence of the enzyme or the microorganism, under the same conditions.

Embodiment 165 is a method of any one of embodiments 107-164, wherein plants grown in the presence of the recombinant *Bacillus cereus* family member, the exosporium fragments, or the formulation exhibit decreased susceptibility to an environmental stress as compared to plants grown in the absence of the enzyme or the microorganism, under the same conditions.

Embodiment 166 is a method of embodiment 165, wherein the environmental stress comprises drought, flood, heat, freezing, salt, heavy metals, low pH, high pH, or a combination of any thereof.

Embodiment 167 is a method of any one of embodiments 107-166, wherein plants grown in the presence of the recombinant *Bacillus cereus* family member, the exosporium fragments, or the formulation exhibit increased nutrient content as compared to plants grown in the absence of the enzyme, the expansin protein, or the microorganism, under the same conditions.

Embodiment 168 is a method of embodiment 167, wherein the nutrient comprises a polysaccharide, a protein, phytic acid, a phosphatate, a phospholipid, or a combination of any thereof.

Embodiment 169 is a method of any one of embodiments 107-168, wherein plants grown in the presence of the recombinant *Bacillus cereus* family member, the exosporium fragments, or the formulation exhibit increased root nodulation as compared to plants grown in the absence of the enzyme or the microorganism, under the same conditions.

Embodiment 170 is a method of any one of embodiments 107-169, wherein plants grown in the presence of the recombinant *Bacillus cereus* family member, the exosporium fragments, or the formulation exhibit slower fruit ripening as compared to plants grown in the absence of the enzyme or the microorganism, under the same conditions.

Embodiment 171 is a method of any one of embodiments 107-170, wherein plants grown in the presence of the recombinant *Bacillus cereus* family member, the exosporium fragments, or the formulation exhibit greater crop yield as compared to plants grown in the absence of the enzyme, the expansin protein, or the microorganism, under the same conditions.

Embodiment 172 is a method of any one of embodiments 107-171, wherein plants grown in the presence of the recombinant *Bacillus cereus* family member, the exosporium fragments, or the formulation exhibit altered leaf senescence as compared to plants grown in the absence of the enzyme or the microorganism, under the same conditions.

Embodiment 173 is a method for delivering an enzyme to an animal, comprising feeding to the animal a recombinant *Bacillus cereus* family member of embodiment 74, exosporium fragments of embodiment 75, or a combination thereof.

Embodiment 174 is a method of embodiment 173, wherein the recombinant *Bacillus cereus* family member or the exosporium fragments are in an animal feed additive or an animal feed composition.

Embodiment 175 is a method of embodiment 174, wherein the animal feed additive comprises an animal feed additive of any one of embodiments 93, 94, and 97-100 or wherein the animal feed composition comprises an animal feed composition of any one of embodiments 95-106.

Embodiment 176 is a method of any one of embodiments 173-175, wherein the method comprises applying the recombinant *Bacillus cereus* family member or the exosporium fragments to a plant, to a plant seed, or to crop residue and feeding the plant, plant seed, or crop residue to the animal.

Embodiment 177 is a method of embodiment 176, wherein the method comprises applying the recombinant *Bacillus cereus* family member or the exosporium fragments to the plant or plant seed prior to harvest.

Embodiment 178 is a method of embodiment 177, wherein the method comprises applying the recombinant *Bacillus cereus* family member or the exosporium fragments to the plant or plant seed after harvest.

Embodiment 179 is a method of any one of embodiments 176-178, wherein the plant or plant seed comprises a soybean, barley, wheat, rye, oat, rice, millet, sorghum, grass, or alfalfa plant or plant seed, or a combination of any thereof.

Embodiment 180 is a method of any one of embodiments 173-179, wherein the animal comprises a livestock animal or a companion animal.

Embodiment 181 is a method of embodiment 180, wherein the animal comprises poultry, swine, cattle, a horse, a goat, a sheep, a dog, a cat, a fish, a rabbit, or a rodent.

Embodiment 182 is a fusion protein of any one of embodiments 1-73, a recombinant *Bacillus cereus* family member of embodiment 74, exosporium fragments of embodiment 75, a formulation of any one of embodiments 76-88, 114, 115, 118, 130-132, and 135-148, a seed of any one of embodiments 89-92, 114, 115, 118, 130-132, 143, and 148, an animal feed additive of any one of embodiments 93, 94, and 97-100, an animal feed composition of any one of embodiments 95-106, or a method of any one of embodiments 107-181, wherein the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase further comprises a signal peptide.

Embodiment 183 is a fusion protein, recombinant *Bacillus cereus* family member, exosporium fragments, formulation, seed, animal feed additive, animal feed composition, or method of embodiment 182, wherein the signal peptide is present at the amino terminus of the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

Embodiment 184 is a fusion protein, recombinant *Bacillus cereus* family member, exosporium fragments, formulation, seed, animal feed additive, animal feed composition, or method of embodiment 182 or 183, wherein the signal peptide comprises an amino acid sequence having at least 70%, at least 75%, at least 80%, at least 85%, at least 90%, at least 95%, at least 98%, at least 99%, or 100% identity with any one of SEQ ID NOs. 317-360 and 376-379.

Embodiment 185 is a fusion protein, recombinant *Bacillus cereus* family member, exosporium fragments, formulation, seed, animal feed additive, animal feed composition, or method of any one of embodiments 182-184, wherein:

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 252, and wherein the phospholipase further comprises a signal peptide comprising SEQ ID NO: 317 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 253, and wherein the phospholipase further comprises a signal peptide comprising SEQ ID NO: 318 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 254, and wherein the phospholipase further comprises a signal peptide comprising SEQ ID NO: 319 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 255, and wherein the phospholipase further comprises a signal peptide comprising SEQ ID NO: 320 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 256, and wherein the phospholipase further comprises a signal peptide comprising SEQ ID NO: 321 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 256, and wherein the phospholipase further comprises a signal peptide comprising SEQ ID NO: 322 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 257, and wherein the phospholipase further comprises a signal peptide comprising SEQ ID NO: 323 at its amino terminus;

the fusion protein comprises a lipase comprising an amino acid sequence having at least 70%, at least 75%, at least 80%, at least 85%, at least 90%, at least 95%, at least 98%, at least 99%, or 100% identity to SEQ ID NO: 263, and wherein the lipase further comprises a signal peptide comprising SEQ ID NO: 324 at its amino terminus;

the fusion protein comprises a lipase comprising an amino acid sequence having at least 70%, at least 75%, at least 80%, at least 85%, at least 90%, at least 95%, at least 98%, at least 99%, or 100% identity to SEQ ID NO: 264, and wherein the lipase further comprises a signal peptide comprising SEQ ID NO: 325 at its amino terminus;

the fusion protein comprises a lipase comprising an amino acid sequence having at least 70%, at least 75%, at least 80%, at least 85%, at least 90%, at least 95%, at least 98%, at least 99%, or 100% identity to SEQ ID NO: 265, and wherein the lipase further comprises a signal peptide comprising SEQ ID NO: 326 at its amino terminus;

the fusion protein comprises a xylanase comprising an amino acid sequence having at least 70%, at least 75%, at least 80%, at least 85%, at least 90%, at least 95%, at least 98%, at least 99%, or 100% identity to SEQ ID NO: 267, and wherein the xylanase further comprises a signal peptide comprising SEQ ID NO: 327 at its amino terminus;

the fusion protein comprises a xylanase comprising an amino acid sequence having at least 70%, at least 75%, at least 80%, at least 85%, at least 90%, at least 95%, at least 98%, at least 99%, or 100% identity to SEQ ID NO: 268, and wherein the xylanase further comprises a signal peptide comprising SEQ ID NO: 328 at its amino terminus;

the fusion protein comprises a xylanase comprising an amino acid sequence having at least 70%, at least 75%, at least 80%, at least 85%, at least 90%, at least 95%, at least 98%, at least 99%, or 100% identity to SEQ ID NO: 269, and wherein the xylanase further comprises a signal peptide comprising SEQ ID NO: 329 at its amino terminus;

the fusion protein comprises a xylanase comprising an amino acid sequence having at least 70%, at least 75%, at least 80%, at least 85%, at least 90%, at least 95%, at least 98%, at least 99%, or 100% identity to SEQ ID NO: 270, and wherein the xylanase further comprises a signal peptide comprising SEQ ID NO: 330 at its amino terminus;

the fusion protein comprises a xylanase comprising an amino acid sequence having at least 70%, at least 75%, at least 80%, at least 85%, at least 90%, at least 95%, at least 98%, at least 99%, or 100% identity to SEQ ID NO: 273, and wherein the xylanase further comprises a signal peptide comprising SEQ ID NO: 331 at its amino terminus;

the fusion protein comprises a chitosanase consisting essentially of an amino acid sequence having at least 70%, at least 75%, at least 80%, at least 85%, at least 90%, at least 95%, at least 98%, at least 99%, or 100% identity to SEQ ID NO: 279, and wherein the chitosanase further comprises a signal peptide comprising SEQ ID NO: 332 at its amino terminus;

the fusion protein comprises a chitosanase comprising an amino acid sequence having at least 70%, at least 75%, at least 80%, at least 85%, at least 90%, at least 95%, at least 98%, at least 99%, or 100% identity to SEQ ID NO: 280, and wherein the chitosanase further comprises a signal peptide comprising SEQ ID NO: 333 at its amino terminus;

the fusion protein comprises a glucanase consists essentially of an amino acid sequence having at least 70%, at least 75%, at least 80%, at least 85%, at least 90%, at least 95%, at least 98%, at least 99%, or 100% identity to SEQ ID NO: 294, and wherein the glucanase further comprises a signal peptide comprising SEQ ID NO: 334 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 295, and wherein the glucanase further comprises a signal peptide comprising SEQ ID NO: 335 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 296, and wherein the glucanase further comprises a signal peptide comprising SEQ ID NO: 336 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 297, and wherein the glucanase further comprises a signal peptide comprising SEQ ID NO: 337 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 298, and wherein the glucanase further comprises a signal peptide comprising SEQ ID NO: 338 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 299, and wherein the glucanase further comprises a signal peptide comprising SEQ ID NO: 339 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 300, and wherein the glucanase further comprises a signal peptide comprising SEQ ID NO: 340 at its amino terminus;

the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 302, and wherein the glucanase further comprises a signal peptide comprising SEQ ID NO: 341 at its amino terminus;

the fusion protein comprises a protease comprising an amino acid sequence having at least 70%, at least 75%, at least 80%, at least 85%, at least 90%, at least 95%, at least 98%, at least 99%, or 100% identity to SEQ ID NO: 304, and wherein the protease further comprises a signal peptide comprising SEQ ID NO: 342 at its amino terminus;

the fusion protein comprises a protease comprising an amino acid sequence having at least 70%, at least 75%, at least 80%, at least 85%, at least 90%, at least 95%, at least 98%, at least 99%, or 100% identity to SEQ ID NO: 306, and wherein the protease further comprises a signal peptide comprising SEQ ID NO: 343 at its amino terminus;

the fusion protein comprises a mannanase comprising an amino acid sequence having at least 70%, at least 75%, at least 80%, at least 85%, at least 90%, at least 95%, at least 98%, at least 99%, or 100% identity to SEQ ID NO: 307, and wherein the mannanase further comprises a signal peptide comprising SEQ ID NO: 344 at its amino terminus;

the fusion protein comprises a mannanase comprising an amino acid sequence having at least 70%, at least 75%, at least 80%, at least 85%, at least 90%, at least 95%, at least 98%, at least 99%, or 100% identity to SEQ ID NO: 308, and wherein the mannanase further comprises a signal peptide comprising SEQ ID NO: 345 at its amino terminus;

the fusion protein comprises a pectolyase comprising an amino acid sequence having at least 70%, at least 75%, at least 80%, at least 85%, at least 90%, at least 95%, at least 98%, at least 99%, or 100% identity to SEQ ID NO: 309, and wherein the pectolyase further comprises a signal peptide comprising SEQ ID NO: 346 at its amino terminus;

the fusion protein comprises a pectolyase comprising an amino acid sequence having at least 70%, at least 75%, at least 80%, at least 85%, at least 90%, at least 95%, at least 98%, at least 99%, or 100% identity to SEQ ID NO: 310, and wherein the pectolyase further comprises a signal peptide comprising SEQ ID NO: 347 at its amino terminus;

the fusion protein comprises an acid phosphatase comprising an amino acid sequence having at least 70%, at least 75%, at least 80%, at least 85%, at least 90%, at least 95%, at least 98%, at least 99%, or 100% identity to SEQ ID NO: 311, and wherein the acid phosphatase further comprises a signal peptide comprising SEQ ID NO: 348 at its amino terminus;

the fusion protein comprises an acid phosphatase comprising an amino acid sequence having at least 70%, at least 75%, at least 80%, at least 85%, at least 90%, at least 95%, at least 98%, at least 99%, or 100% identity to SEQ ID NO: 312, and wherein the acid phosphatase further comprises a signal peptide comprising SEQ ID NO: 349 at its amino terminus;

the fusion protein comprises a phytase comprising an amino acid sequence having at least 70%, at least 75%, at least 80%, at least 85%, at least 90%, at least 95%, at least 98%, at least 99%, or 100% identity to SEQ ID NO: 313, and wherein the phytase further comprises a signal peptide comprising SEQ ID NO: 350 at its amino terminus;

the fusion protein comprises a phytase comprising an amino acid sequence having at least 70%, at least 75%, at least 80%, at least 85%, at least 90%, at least 95%, at least 98%, at least 99%, or 100% identity to SEQ ID NO: 314, and wherein the phytase further comprises a signal peptide comprising SEQ ID NO: 350 at its amino terminus;

the fusion protein comprises a phytase comprising an amino acid sequence having at least 70%, at least 75%, at least 80%, at least 85%, at least 90%, at least 95%, at least 98%, at least 99%, or 100% identity to SEQ ID NO: 315, and wherein the phytase further comprises a signal peptide comprising SEQ ID NO: 351 at its amino terminus;

the fusion protein comprises an expansin protein comprising an amino acid sequence having at least 70%, at least 75%, at least 80%, at least 85%, at least 90%, at least 95%, at least 98%, at least 99%, or 100% identity to SEQ ID NO: 316, and wherein the expansin protein further comprises a signal peptide comprising SEQ ID NO: 352 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 373, and wherein the phospholipase further comprises a signal peptide comprising SEQ ID NO: 376 at its amino terminus;

the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 375, and wherein the phospholipase further comprises a signal peptide comprising SEQ ID NO: 377 at its amino terminus;

the fusion protein comprises a phytase comprising an amino acid sequence having at least 70%, at least 75%, at least 80%, at least 85%, at least 90%, at least 95%, at least 98%, at least 99%, or 100% identity to SEQ ID NO: 380, and wherein the phytase further comprises a signal peptide comprising SEQ ID NO: 354 at its amino terminus; or the fusion protein comprises an acid phosphatase comprising an amino acid sequence having at least 70%, at least 75%, at least 80%, at least 85%, at least 90%, at least 95%, at least 98%, at least 99%, or 100% identity to SEQ ID NO: 378, and wherein the acid phosphatase further comprises a signal peptide comprising SEQ ID NO: 379 at its amino terminus.

Embodiment 186 is a fusion protein, recombinant *Bacillus cereus* family member, exosporium fragments, formulation, seed, animal feed additive, animal feed composition, or method of embodiment 185, wherein the fusion protein comprises a glucanase consisting essentially of an amino acid sequence having at least 70%, at least 75%, at least 80%, at least 85%, at least 90%, at least 95%, at least 98%, at least 99%, or 100% identity to SEQ ID NO: 294, and wherein the glucanase further comprises a signal peptide comprising SEQ ID NO: 334 at its amino terminus.

Embodiment 187 is a fusion protein, recombinant *Bacillus cereus* family member, exosporium fragments, formulation, seed, animal feed additive, animal feed composition, or method of embodiment 185, wherein the fusion protein comprises a glucanase comprising an amino acid sequence having at least 70%, at least 75%, at least 80%, at least 85%, at least 90%, at least 95%, at least 98%, at least 99%, or 100% identity to SEQ ID NO: 295, and wherein the glucanase further comprises a signal peptide comprising SEQ ID NO: 335 at its amino terminus.

Embodiment 188 is a fusion protein, recombinant *Bacillus cereus* family member, exosporium fragments, formulation, seed, animal feed additive, animal feed composition, or method of embodiment 185, wherein the fusion protein comprises a xylanase comprising an amino acid sequence having at least 70%, at least 75%, at least 80%, at least 85%, at least 90%, at least 95%, at least 98%, at least 99%, or 100% identity to SEQ ID NO: 268, and wherein the xylanase further comprises a signal peptide comprising SEQ ID NO: 328 at its amino terminus.

Embodiment 189 is a fusion protein, recombinant *Bacillus cereus* family member, exosporium fragments, formulation, seed, animal feed additive, animal feed composition, or method of embodiment 185, wherein the fusion protein comprises a pectolyase comprising an amino acid sequence having at least 70%, at least 75%, at least 80%, at least 85%, at least 90%, at least 95%, at least 98%, at least 99%, or 100% identity to SEQ ID NO: 309, and wherein the pectolyase further comprises a signal peptide comprising SEQ ID NO: 346 at its amino terminus.

Embodiment 190 is a fusion protein, recombinant *Bacillus cereus* family member, exosporium fragments, formulation, seed, animal feed additive, animal feed composition, or method of embodiment 185, wherein the fusion protein comprises a phospholipase comprising an amino acid sequence having at least 70%, at least 75%, at least 80%, at least 85%, at least 90%, at least 95%, at least 98%, at least 99%, or 100% identity to SEQ ID NO: 373, and wherein the phospholipase further comprises a signal peptide comprising SEQ ID NO: 376 at its amino terminus.

Embodiment 191 is a recombinant *Bacillus cereus* family member of any one of embodiments 74 and 182-190, exosporium fragments of any one of embodiments 75 and 182-190, a formulation of any one of embodiments 76-88, 114, 115, 118, 130-132, 135-148, and 182-190, a seed of any one of embodiments 89-92, 114, 115, 118, 130-132, 143, 148, and 182-190, an animal feed additive of any one of embodiments 93, 94, 97-100, and 182-190, an animal feed composition of any one of embodiments 95-106 and 182-190, or a method of any one of embodiments 107-181, wherein the recombinant *Bacillus cereus* family member is in the form of a spore.

Embodiment 192 is a recombinant *Bacillus cereus* family member, exosporium fragments, formulation, animal feed additive, animal feed composition, seed, or method of embodiment 191, wherein the spore is inactivated.

Embodiment 193 is a method of any one of embodiments 107-121, 123-128, and 130-190, wherein the method further comprises inactivating the recombinant *Bacillus cereus* family member prior to applying the recombinant *Bacillus cereus* family member to the plant growth medium, the plant, the plant seed, or the area surrounding the plant or the plant seed or prior to feeding the recombinant the recombinant *Bacillus cereus* family member to the animal.

Embodiment 194 is a recombinant *Bacillus cereus* family member of any one of embodiments 74 and 182-192, exosporium fragments of any one of embodiments 75 and 182-192, a formulation of any one of embodiments 76-88, 114, 115, 118, 130-132, 135-148, and 182-192, a seed of any one of embodiments 89-92, 114, 115, 118, 130-132, 143, 148, and 182-192, an animal feed additive of any one of embodiments 93. 94, 97-100, and 182-192, an animal feed composition of any one of embodiments 95-106 and 182-192, or a method of any one of embodiments 107-193, wherein the recombinant *Bacillus cereus* family member comprises *Bacillus anthracis*, *Bacillus cereus*, *Bacillus thuringiensis*, *Bacillus mycoides*, *Bacillus pseudomycoides*, *Bacillus samanii*, *Bacillus gaemokensis*, *Bacillus weihenstephensis*, *Bacillus toyoiensis*, or a combination of any thereof.

Embodiment 195 is a recombinant *Bacillus cereus* family member of any one of embodiments 74, 182-192, and 194, exosporium fragments of any one of embodiments 75, 182-192, and 194, a formulation of any one of embodiments 76-88, 114, 115, 118, 130-132, 135-148, 182-192, and 194, a seed of any one of embodiments 89-92, 114, 115, 118, 130-132, 143, 148, 182-192, and 194, an animal feed additive of any one of embodiments 93. 94, 97-100, 182-192 and 194, an animal feed composition of any one of embodiments 95-106, 182-192, and 194, or a method of any one of embodiments 107-194, wherein the recombinant *Bacillus cereus* family member comprises a plant-growth promoting strain of bacteria, an endophytic strain of bacteria, or a strain of bacteria that is both plant-growth promoting and endophytic.

Embodiment 196 is a recombinant *Bacillus cereus* family member, exosporium fragments, a formulation, a seed, an animal feed additive, an animal feed composition, or method of embodiment 195, wherein the strain of bacteria produces an insecticidal toxin, produces a fungicidal compound, produces a nematicidal compound, produces a bacteriocidal compound, is resistant to one or more antibiotics, comprises one or more freely replicating plasmids, binds to plant roots, colonizes plant roots, forms biofilms, solubilizes nutrients, secretes organic acids, or a combination of any thereof.

Embodiment 197 is a recombinant *Bacillus cereus* family member, exosporium fragments, a formulation, a seed, an animal feed additive, an animal feed composition, or method of embodiment 196, wherein the insecticidal toxin comprises a Cry toxin; wherein the fungicidal compound comprises a β-1,3-glucanase, a chitosanase, a lyticase, or a combination of any thereof; or wherein the nematicidal compound comprises a Cry toxin.

Embodiment 198 is a recombinant *Bacillus cereus* family member, exosporium fragments, a formulation, a seed, an animal feed additive, an animal feed composition, or method of any one of embodiments 194-197, wherein the recombinant *Bacillus cereus* family member comprises *Bacillus mycoides* BT155 (NRRL No. B-50921), *Bacillus mycoides* EE118 (NRRL No. B-50918), *Bacillus mycoides* EE141 (NRRL No. B-50916), *Bacillus mycoides* BT46-3 (NRRL No. B-50922), *Bacillus cereus* family member EE128 (NRRL No. B-50917), *Bacillus thuringiensis* BT013A (NRRL No. B-50924), *Bacillus cereus* family member EE349 (NRRL No. B-50928); *Bacillus cereus* family member EE-B00377 (NRRL B-67119); *Bacillus pseudomycoides* EE-B00366 (NRRL B-67120); *Bacillus mycoides* EE-B00363 (NRRL B-67121); *Bacillus cereus* family member EE439 (NRRL B-50979); *Bacillus thuringiensis* EE417 (NRRL B-50974); *Bacillus cereus* EE444 (NRRL B-50977); *Bacillus thuringiensis* EE319 (NRRL B-50983); *Bacillus mycoides* EE116 (NRRL No. B-50919); or *Bacillus thuringiensis* EE-B00184 (NRRL B-67122).

Embodiment 199 is a recombinant *Bacillus cereus* family member, exosporium fragments, a formulation, a seed, an animal feed additive, an animal feed composition, or method of embodiment 198, wherein the recombinant *Bacillus cereus* family member comprises *Bacillus thuringiensis* BT013A (NRRL No. B-50924).

Embodiment 200 is a recombinant *Bacillus cereus* family member, exosporium fragments, a formulation, a seed, an animal feed additive, an animal feed composition, or method of embodiment 198, wherein the recombinant *Bacillus cereus* family member comprises *Bacillus cereus* family member EE349 (NRRL No. B-50928).

Embodiment 201 is exosporium fragments of any one of embodiments 75, 182-192 and 194-200, a formulation of any one of embodiments 76-88, 114, 115, 118, 130-132, 135-148, 182-192, and 194-200, a seed of any one of embodiments 89-92, 114, 115, 118, 130-132, 143, 148, 182-192, and 194-200, an animal feed additive of any one of embodiments 93. 94, 97-100, 182-192 and 194-200, an animal feed composition of any one of embodiments 96-106, 182-192, and 194, and 147-153, or a method of any one of embodiments 107-200, wherein the exosporium fragments are derived from spores of a recombinant *Bacillus cereus* family member that expresses the fusion protein, wherein the recombinant *Bacillus cereus* family member also comprises a mutation or expresses a protein, wherein the expression of the protein is increased as compared to the expression of the protein in a wild-type *Bacillus cereus* family member under the same conditions, and wherein the mutation or the increased expression of the protein results in *Bacillus cereus* family member spores having an exosporium that is easier to remove from the spore as compared to the exosporium of a wild-type spore.

Embodiment 202 is exosporium fragments, a formulation, a seed, an animal feed additive, an animal feed composition, or a method of embodiment 201, wherein the recombinant *Bacillus cereus* family member:
(i) comprises a mutation in a CotE gene;
(ii) expresses an ExsY protein, wherein the expression of the ExsY protein is increased as compared to the expression of the ExsY protein in a wild-type *Bacillus cereus* family member under the same conditions, and wherein the ExsY protein comprises a carboxy-terminal tag comprising a globular protein;
(iii) expresses a BclB protein, wherein the expression of the BclB protein is increased as compared to the expression of the BclB protein in a wild-type *Bacillus cereus* family member under the same conditions;
(iv) expresses a YjcB protein, wherein the expression of the YjcB protein is increased as compared to the expression of the YjcB protein in a wild-type *Bacillus cereus* family member under the same conditions;
(v) comprises a mutation in an ExsY gene;
(vi) comprises a mutation in a CotY gene;
(vii) comprises a mutation in an ExsA gene; or
(viii) comprises a mutation in a CotO gene.

Embodiment 203 is exosporium fragments, a formulation, a seed, an animal feed additive, an animal feed composition, or a method of embodiment 201 or 202, wherein the recombinant *Bacillus cereus* family member comprises a mutation in a CotE gene.

Embodiment 204 is exosporium fragments, a formulation, a seed, an animal feed additive, an animal feed composition, or a method of embodiment 203, wherein the mutation in the CotE gene partially or completely inhibits the ability of CotE to attach the exosporium to the spore.

Embodiment 205 is exosporium fragments, a formulation, a seed, an animal feed additive, an animal feed composition, or a method of embodiment 203 or 204, wherein the mutation in the CotE gene comprises a knock-out of the CotE gene or a dominant negative form of the CotE gene.

Embodiment 206 is exosporium fragments, a formulation, a seed, an animal feed additive, an animal feed composition, or a method of any one of embodiments 201-205, wherein the recombinant *Bacillus cereus* family member expresses an ExsY protein, wherein the expression of the ExsY protein is increased as compared to the expression of the ExsY protein in a wild-type *Bacillus cereus* family member under the same conditions, and wherein the ExsY protein comprises a carboxy-terminal tag comprising a globular protein.

Embodiment 207 is exosporium fragments, a formulation, a seed, an animal feed additive, an animal feed composition, or a method of embodiment 206, wherein the globular protein has a molecular weight of between 25 kDa and 100 kDa.

Embodiment 208 is exosporium fragments, a formulation, a seed, an animal feed additive, an animal feed composition, or a method of embodiment 206 or 207, wherein the globular protein comprises a green fluorescent protein (GFP) or a variant thereof.

Embodiment 209 is exosporium fragments, a formulation, a seed, an animal feed additive, an animal feed composition, or a method of any one of embodiments 206-208, wherein the expression of the ExsY protein comprising the carboxy-terminal tag comprising a globular protein inhibits binding of the ExsY protein to its targets in the exosporium.

Embodiment 210 is exosporium fragments, a formulation, a seed, an animal feed additive, an animal feed composition, or a method of any one of embodiments 201-209, wherein the recombinant *Bacillus cereus* family member expresses a BclB protein, wherein the expression of the BclB protein is increased as compared to the expression of the BclB protein in a wild-type *Bacillus cereus* family member under the same conditions.

Embodiment 211 is exosporium fragments, a formulation, a seed, an animal feed additive, an animal feed composition, or a method of embodiment 210, wherein the expression of the BclB protein results in the formation of a fragile exosporium.

Embodiment 212 is exosporium fragments, a formulation, a seed, an animal feed additive, an animal feed composition, or a method of any one of embodiments 201-211, wherein the recombinant *Bacillus cereus* family member expresses a YjcB protein, wherein the expression of the YjcB protein is increased as compared to the expression of the YjcB protein in a wild-type *Bacillus cereus* family member under the same conditions.

Embodiment 213 is exosporium fragments, a formulation, a seed, an animal feed additive, an animal feed composition, or a method of embodiment 212, wherein the expression of the YjcB protein causes the exosporium to form in pieces rather than in a complete structure.

Embodiment 214 is exosporium fragments, a formulation, a seed, an animal feed additive, an animal feed composition, or a method of any one of embodiments 201-213, wherein the recombinant *Bacillus cereus* family member comprises a mutation an ExsY gene.

Embodiment 215 is exosporium fragments, a formulation, a seed, an animal feed additive, an animal feed composition, or a method of embodiment 214, wherein the mutation in the ExsY gene partially or completely inhibits the ability of ExsY to complete the formation of the exosporium or attach the exosporium to the spore.

Embodiment 216 is exosporium fragments, a formulation, a seed, an animal feed additive, an animal feed composition, or a method of embodiment 214 or 215, wherein the mutation in the ExsY gene comprises a knock-out of the ExsY gene.

Embodiment 217 is exosporium fragments, a formulation, a seed, an animal feed additive, an animal feed composition, or a method of any one of embodiments 201-216, wherein the recombinant *Bacillus cereus* family member comprises a mutation in a CotY gene.

Embodiment 218 is exosporium fragments, a formulation, a seed, an animal feed additive, an animal feed composition, or a method of embodiment 217, wherein the mutation in the CotY gene comprises a knock-out of the CotY gene.

Embodiment 219 is exosporium fragments, a formulation, a seed, an animal feed additive, an animal feed composition, or a method of embodiment 217 or 218, wherein the mutation in the CotY gene results in the formation of a fragile exosporium.

Embodiment 220 is exosporium fragments, a formulation, a seed, an animal feed additive, an animal feed composition, or a method of any one of embodiments 201-219, wherein the recombinant *Bacillus cereus* family member comprises a mutation in an ExsA gene.

Embodiment 221 is exosporium fragments, a formulation, a seed, an animal feed additive, an animal feed composition, or a method of embodiment 220, wherein the mutation in the ExsA gene comprises a knock-out of the ExsA gene.

Embodiment 222 is exosporium fragments, a formulation, a seed, an animal feed additive, an animal feed composition, or a method of embodiment 220 or 221, wherein the mutation in the ExsA gene results in the formation of a fragile exosporium.

Embodiment 223 is exosporium fragments, a formulation, a seed, an animal feed additive, an animal feed composition, or a method of any one of embodiments 201-222, wherein the recombinant *Bacillus cereus* family member comprises a mutation in a CotO gene.

Embodiment 224 is exosporium fragments, a formulation, a seed, an animal feed additive, an animal feed composition, or a method of embodiment 223, wherein the mutation in the CotO gene comprises a knock-out of the CotO gene or a dominant negative form of the CotO gene.

Embodiment 225 is exosporium fragments, a formulation, a seed, an animal feed additive, an animal feed composition, or a method of embodiment 223 or 224, wherein the mutation in the CotO gene causes the exosporium to form in strips.

Embodiment 226 is a fusion protein of any one of embodiments 1-73 and 182-190, a recombinant *Bacillus cereus* family member of any one of embodiments 74, 182-192, and 194-200, exosporium fragments of any one of embodiments 75, 182-192, and 194-225, a formulation of any one of embodiments 76-88, 114, 115, 118, 130-132, 135-148, 182-192, and 194-225, a seed of any one of embodiments 89-92, 114, 115, 118, 130-132, 143, 148, 182-192, and 194-225, an animal feed additive of any one of embodiments 93, 94, 97-100, and 182-225, an animal feed composition of any one of embodiments 95-106 and 182-225, or a method of any one of embodiments 107-225, wherein the targeting sequence, exosporium protein, or exosporium protein fragment comprises:

(1) a targeting sequence comprising an amino acid sequence having at least about 43% identity with amino acids 20-35 of SEQ ID NO: 1, wherein the identity with amino acids 25-35 is at least about 54%;

(2) a targeting sequence comprising amino acids 1-35 of SEQ ID NO: 1;

(3) a targeting sequence comprising amino acids 20-35 of SEQ ID NO: 1;

(4) a targeting sequence comprising SEQ ID NO: 1;

(5) an exosporium protein comprising an amino acid sequence having at least 85% identity with SEQ ID NO: 2;

(6) a targeting sequence comprising amino acids 2-35 of SEQ ID NO: 1;

(7) a targeting sequence comprising amino acids 5-35 of SEQ ID NO: 1;

(8) a targeting sequence comprising amino acids 8-35 of SEQ ID NO: 1;

(9) a targeting sequence comprising amino acids 10-35 of SEQ ID NO: 1;

(10) a targeting sequence comprising amino acids 15-35 of SEQ ID NO: 1;

(11) a targeting sequence comprising amino acids 1-27 of SEQ ID NO: 3;

(12) a targeting sequence comprising amino acids 12-27 of SEQ ID NO: 3;

(13) a targeting sequence comprising SEQ ID NO: 3;

(14) an exosporium protein comprising an amino acid sequence having at least 85% identity with SEQ ID NO: 4;

(15) a targeting sequence comprising amino acids 2-27 of SEQ ID NO: 3;

(16) a targeting sequence comprising amino acids 5-27 of SEQ ID NO: 3;

(17) a targeting sequence comprising amino acids 8-27 of SEQ ID NO: 3;

(18) a targeting sequence comprising amino acids 10-27 of SEQ ID NO: 3;

(19) a targeting sequence comprising amino acids 1-38 of SEQ ID NO: 5;

(20) a targeting sequence comprising amino acids 23-38 of SEQ ID NO: 5;

(21) a targeting sequence comprising SEQ ID NO: 5;

(22) an exosporium protein comprising an amino acid sequence having at least 85% identity with SEQ ID NO: 6;

(23) a targeting sequence comprising amino acids 2-38 of SEQ ID NO: 5;

(24) a targeting sequence comprising amino acids 5-38 of SEQ ID NO: 5;

(25) a targeting sequence comprising amino acids 8-38 of SEQ ID NO: 5;

(26) a targeting sequence comprising amino acids 10-38 of SEQ ID NO: 5;

(27) a targeting sequence comprising amino acids 15-38 of SEQ ID NO: 5;

(28) a targeting sequence comprising amino acids 20-38 of SEQ ID NO: 5;

(29) a targeting sequence comprising amino acids 1-28 of SEQ ID NO: 7;

(30) a targeting sequence comprising amino acids 13-28 of SEQ ID NO: 7;

(31) a targeting sequence comprising SEQ ID NO: 7;

(32) an exosporium protein comprising an amino acid sequence having at least 85% identity with SEQ ID NO: 8;

(33) a targeting sequence comprising amino acids 2-28 of SEQ ID NO: 7;

(34) a targeting sequence comprising amino acids 5-28 of SEQ ID NO: 7;

(35) a targeting sequence comprising amino acids 8-28 of SEQ ID NO: 7;

(36) a targeting sequence comprising amino acids 10-28 of SEQ ID NO: 7;
(37) a targeting sequence comprising amino acids 1-24 of SEQ ID NO: 9;
(38) a targeting sequence comprising amino acids 9-24 of SEQ ID NO: 9;
(39) a targeting sequence comprising SEQ ID NO: 9;
(40) an exosporium protein comprising an amino acid sequence having at least 85% identity with SEQ ID NO: 10;
(41) a targeting sequence comprising amino acids 2-24 of SEQ ID NO: 9;
(42) a targeting sequence comprising amino acids 5-24 of SEQ ID NO: 9;
(43) a targeting sequence comprising amino acids 8-24 of SEQ ID NO: 9;
(44) a targeting sequence comprising amino acids 1-33 of SEQ ID NO:11;
(45) a targeting sequence comprising amino acids 18-33 of SEQ ID NO: 11;
(46) a targeting sequence comprising SEQ ID NO: 11;
(47) an exosporium protein comprising an amino acid sequence having at least 85% identity with SEQ ID NO: 12;
(48) a targeting sequence comprising amino acids 2-33 of SEQ ID NO: 11;
(49) a targeting sequence comprising amino acids 5-33 of SEQ ID NO: 11;
(50) a targeting sequence comprising amino acids 8-33 of SEQ ID NO: 11;
(51) a targeting sequence comprising amino acids 10-33 of SEQ ID NO: 11;
(52) a targeting sequence comprising amino acids 15-33 of SEQ ID NO: 11;
(53) a targeting sequence comprising amino acids 1-33 of SEQ ID NO: 13;
(54) a targeting sequence comprising amino acids 18-33 of SEQ ID NO: 13;
(55) a targeting sequence comprising SEQ ID NO:13;
(56) an exosporium protein comprising an amino acid sequence having at least 85% identity with SEQ ID NO:14;
(57) a targeting sequence comprising amino acids 2-33 of SEQ ID NO: 13;
(58) a targeting sequence comprising amino acids 5-33 of SEQ ID NO: 13;
(59) a targeting sequence comprising amino acids 8-33 of SEQ ID NO: 13;
(60) a targeting sequence comprising amino acids 10-33 of SEQ ID NO: 13;
(61) a targeting sequence comprising amino acids 15-33 of SEQ ID NO: 13;
(62) a targeting sequence comprising amino acids 1-43 of SEQ ID NO: 15;
(63) a targeting sequence comprising amino acids 28-43 of SEQ ID NO: 15;
(64) a targeting sequence comprising SEQ ID NO:15;
(65) an exosporium protein comprising an amino acid sequence having at least 85% identity with SEQ ID NO:16;
(66) a targeting sequence comprising amino acids 2-43 of SEQ ID NO: 15;
(67) a targeting sequence comprising amino acids 5-43 of SEQ ID NO: 15;
(68) a targeting sequence comprising amino acids 8-43 of SEQ ID NO: 15;
(69) a targeting sequence comprising amino acids 10-43 of SEQ ID NO: 15;
(70) a targeting sequence comprising amino acids 15-43 of SEQ ID NO: 15;
(71) a targeting sequence comprising amino acids 20-43 of SEQ ID NO: 15;
(72) a targeting sequence comprising amino acids 25-43 of SEQ ID NO: 15;
(73) a targeting sequence comprising amino acids 1-27 of SEQ ID NO: 17;
(74) a targeting sequence comprising amino acids 12-27 of SEQ ID NO: 17;
(75) a targeting sequence comprising SEQ ID NO:17;
(76) an exosporium protein comprising an amino acid sequence having at least 85% identity with SEQ ID NO:18;
(77) a targeting sequence comprising amino acids 2-27 of SEQ ID NO: 17;
(78) a targeting sequence comprising amino acids 5-27 of SEQ ID NO: 17;
(79) a targeting sequence comprising amino acids 8-27 of SEQ ID NO: 17;
(80) a targeting sequence comprising amino acids 10-27 of SEQ ID NO: 17;
(81) a targeting sequence comprising amino acids 1-33 of SEQ ID NO: 19;
(82) a targeting sequence comprising amino acids 18-33 of SEQ ID NO: 19;
(83) a targeting sequence comprising SEQ ID NO:19;
(84) an exosporium protein comprising an amino acid sequence having at least 85% identity with SEQ ID NO:20;
(85) a targeting sequence comprising amino acids 2-33 of SEQ ID NO: 19;
(86) a targeting sequence comprising amino acids 5-33 of SEQ ID NO: 19;
(87) a targeting sequence comprising amino acids 8-33 of SEQ ID NO: 19;
(88) a targeting sequence comprising amino acids 10-33 of SEQ ID NO: 19;
(89) a targeting sequence comprising amino acids 15-33 of SEQ ID NO: 19;
(90) a targeting sequence comprising amino acids 1-33 of SEQ ID NO: 21;
(91) a targeting sequence comprising amino acids 18-33 of SEQ ID NO: 21;
(92) a targeting sequence comprising SEQ ID NO:21;
(93) an exosporium protein comprising an amino acid sequence having at least 85% identity with SEQ ID NO:22;
(94) a targeting sequence comprising amino acids 2-33 of SEQ ID NO: 21;
(95) a targeting sequence comprising amino acids 5-33 of SEQ ID NO: 21;
(96) a targeting sequence comprising amino acids 8-33 of SEQ ID NO: 21;
(97) a targeting sequence comprising amino acids 10-33 of SEQ ID NO: 21;
(98) a targeting sequence comprising amino acids 15-33 of SEQ ID NO: 21;
(99) a targeting sequence comprising amino acids 1-24 of SEQ ID NO: 23;
(100) a targeting sequence comprising amino acids 9-24 of SEQ ID NO: 23;
(101) a targeting sequence comprising SEQ ID NO:23;

(102) an exosporium protein comprising an amino acid sequence having at least 85% identity with SEQ ID NO:24;
(103) a targeting sequence comprising amino acids 2-24 of SEQ ID NO:23;
(104) a targeting sequence comprising amino acids 5-24 of SEQ ID NO: 23;
(105) a targeting sequence comprising amino acids 8-24 of SEQ ID NO: 23;
(106) a targeting sequence comprising amino acids 1-24 of SEQ ID NO: 25;
(107) a targeting sequence comprising amino acids 9-24 of SEQ ID NO: 25;
(108) a targeting sequence comprising SEQ ID NO:25;
(109) an exosporium protein comprising an amino acid sequence having at least 85% identity with SEQ ID NO:26;
(110) a targeting sequence comprising amino acids 2-24 of SEQ ID NO: 25;
(111) a targeting sequence comprising amino acids 5-24 of SEQ ID NO: 25;
(112) a targeting sequence comprising amino acids 8-24 of SEQ ID NO: 25;
(113) a targeting sequence comprising amino acids 1-30 of SEQ ID NO: 27;
(114) a targeting sequence comprising amino acids 15-30 of SEQ ID NO: 27;
(115) a targeting sequence comprising SEQ ID NO:27;
(116) an exosporium protein comprising an amino acid sequence having at least 85% identity with SEQ ID NO:28;
(117) a targeting sequence comprising amino acids 2-30 of SEQ ID NO: 27;
(118) a targeting sequence comprising amino acids 5-30 of SEQ ID NO: 27;
(119) a targeting sequence comprising amino acids 8-30 of SEQ ID NO: 27;
(120) a targeting sequence comprising amino acids 10-30 of SEQ ID NO: 27;
(121) a targeting sequence comprising amino acids 1-33 of SEQ ID NO: 29;
(122) a targeting sequence comprising amino acids 18-33 of SEQ ID NO: 29;
(123) a targeting sequence comprising SEQ ID NO:29;
(124) an exosporium protein comprising an amino acid sequence having at least 85% identity with SEQ ID NO:30;
(125) a targeting sequence comprising amino acids 2-33 of SEQ ID NO: 29;
(126) a targeting sequence comprising amino acids 5-33 of SEQ ID NO: 29;
(127) a targeting sequence comprising amino acids 8-33 of SEQ ID NO: 29;
(128) a targeting sequence comprising amino acids 10-33 of SEQ ID NO: 29;
(129) a targeting sequence comprising amino acids 15-33 of SEQ ID NO: 29;
(130) a targeting sequence comprising amino acids 1-24 of SEQ ID NO: 31;
(131) a targeting sequence comprising amino acids 9-24 of SEQ ID NO: 31;
(132) a targeting sequence comprising SEQ ID NO:31;
(133) an exosporium protein comprising an amino acid sequence having at least 85% identity with SEQ ID NO:32;
(134) a targeting sequence comprising amino acids 2-24 of SEQ ID NO: 31;
(135) a targeting sequence comprising amino acids 5-24 of SEQ ID NO: 31;
(136) a targeting sequence comprising amino acids 8-24 of SEQ ID NO: 31;
(137) a targeting sequence comprising amino acids 1-15 of SEQ ID NO: 33;
(138) a targeting sequence comprising SEQ ID NO:33;
(139) an exosporium protein comprising an amino acid sequence having at least 85% identity with SEQ ID NO:34;
(140) a targeting sequence comprising amino acids 1-16 of SEQ ID NO: 35;
(141) a targeting sequence comprising SEQ ID NO:35;
(142) an exosporium protein comprising an amino acid sequence having at least 85% identity with SEQ ID NO:36;
(143) a targeting sequence comprising amino acids 1-29 of SEQ ID NO:43;
(144) a targeting sequence comprising amino acids 14-29 of SEQ ID NO: 43;
(145) a targeting sequence comprising SEQ ID NO: 43;
(146) an exosporium protein comprising an amino acid sequence having at least 85% identity with SEQ ID NO: 44;
(147) a targeting sequence comprising amino acids 2-29 of SEQ ID NO: 43;
(148) a targeting sequence comprising amino acids 5-29 of SEQ ID NO: 43;
(149) a targeting sequence comprising amino acids 8-29 of SEQ ID NO: 43;
(150) a targeting sequence comprising amino acids 10-29 of SEQ ID NO: 43;
(151) a targeting sequence comprising amino acids 1-35 of SEQ ID NO: 45;
(152) a targeting sequence comprising amino acids 20-35 of SEQ ID NO: 45;
(153) a targeting sequence comprising SEQ ID NO: 45;
(154) an exosporium protein comprising an amino acid sequence having at least 85% identity with SEQ ID NO: 46;
(155) a targeting sequence comprising amino acids 2-35 of SEQ ID NO: 45;
(156) a targeting sequence comprising amino acids 5-35 of SEQ ID NO: 45;
(157) a targeting sequence comprising amino acids 8-35 of SEQ ID NO: 45;
(158) a targeting sequence comprising amino acids 10-35 of SEQ ID NO: 45;
(159) a targeting sequence comprising amino acids 15-35 of SEQ ID NO: 45;
(160) a targeting sequence comprising amino acids 1-43 of SEQ ID NO: 47;
(161) a targeting sequence comprising amino acids 28-43 of SEQ ID NO: 47;
(162) a targeting sequence comprising SEQ ID NO: 47;
(163) an exosporium protein comprising an amino acid sequence having at least 85% identity with SEQ ID NO: 48;
(164) a targeting sequence comprising amino acids 2-43 of SEQ ID NO: 47;
(165) a targeting sequence comprising amino acids 5-43 of SEQ ID NO: 47;
(166) a targeting sequence comprising amino acids 8-43 of SEQ ID NO: 47;
(167) a targeting sequence comprising amino acids 10-43 of SEQ ID NO: 47;

(168) a targeting sequence comprising amino acids 15-43 of SEQ ID NO: 47;
(169) a targeting sequence comprising amino acids 20-43 of SEQ ID NO: 47;
(170) a targeting sequence comprising amino acids 25-43 of SEQ ID NO: 47;
(171) a targeting sequence comprising amino acids 1-32 of SEQ ID NO: 49;
(172) a targeting sequence comprising amino acids 17-32 of SEQ ID NO: 49;
(173) a targeting sequence comprising SEQ ID NO: 49;
(174) an exosporium protein comprising an amino acid sequence having at least 85% identity with SEQ ID NO: 50;
(175) a targeting sequence comprising amino acids 2-32 of SEQ ID NO: 49;
(176) a targeting sequence comprising amino acids 5-32 of SEQ ID NO: 49;
(177) a targeting sequence comprising amino acids 8-32 of SEQ ID NO: 49;
(178) a targeting sequence comprising amino acids 10-32 of SEQ ID NO: 49;
(179) a targeting sequence comprising amino acids 15-32 of SEQ ID NO: 49;
(180) a targeting sequence comprising amino acids 1-33 of SEQ ID NO: 51;
(181) a targeting sequence comprising amino acids 18-33 of SEQ ID NO: 51;
(182) a targeting sequence comprising SEQ ID NO: 51;
(183) an exosporium protein comprising an amino acid sequence having at least 85% identity with SEQ ID NO: 52;
(184) a targeting sequence comprising amino acids 2-33 of SEQ ID NO: 51;
(185) a targeting sequence comprising amino acids 5-33 of SEQ ID NO: 51;
(186) a targeting sequence comprising amino acids 8-33 of SEQ ID NO: 51;
(187) a targeting sequence comprising amino acids 10-33 of SEQ ID NO: 51;
(188) a targeting sequence comprising amino acids 15-33 of SEQ ID NO: 51;
(189) a targeting sequence comprising amino acids 1-33 of SEQ ID NO: 53;
(190) a targeting sequence comprising amino acids 18-33 of SEQ ID NO: 53;
(191) a targeting sequence comprising SEQ ID NO: 53;
(192) an exosporium protein comprising an amino acid sequence having at least 85% identity with SEQ ID NO: 54;
(193) a targeting sequence comprising amino acids 2-33 of SEQ ID NO: 53;
(194) a targeting sequence comprising amino acids 5-33 of SEQ ID NO: 53;
(195) a targeting sequence comprising amino acids 8-33 of SEQ ID NO: 53;
(196) a targeting sequence comprising amino acids 10-33 of SEQ ID NO: 53;
(197) a targeting sequence comprising amino acids 15-33 of SEQ ID NO: 53;
(198) a targeting sequence comprising amino acids 1-30 of SEQ ID NO: 55;
(199) a targeting sequence comprising amino acids 15-30 of SEQ ID NO: 55;
(200) a targeting sequence comprising SEQ ID NO: 55;
(201) an exosporium protein comprising an amino acid sequence having at least 85% identity with SEQ ID NO: 56;
(202) a targeting sequence comprising amino acids 2-30 of SEQ ID NO: 55;
(203) a targeting sequence comprising amino acids 5-30 of SEQ ID NO: 55;
(204) a targeting sequence comprising amino acids 8-30 of SEQ ID NO: 55;
(205) a targeting sequence comprising amino acids 10-30 of SEQ ID NO: 55;
(206) a targeting sequence comprising amino acids 1-130 of SEQ ID NO: 57;
(207) a targeting sequence comprising amino acids 115-130 of SEQ ID NO: 57;
(208) a targeting sequence comprising SEQ ID NO: 57;
(209) an exosporium protein comprising an amino acid sequence having at least 85% identity with SEQ ID NO: 58;
(210) a targeting sequence comprising amino acids 2-130 of SEQ ID NO: 57;
(211) a targeting sequence comprising amino acids 5-130 of SEQ ID NO: 57;
(212) a targeting sequence comprising amino acids 10-130 of SEQ ID NO: 57;
(213) a targeting sequence comprising amino acids 20-130 of SEQ ID NO: 57;
(214) a targeting sequence comprising amino acids 30-130 of SEQ ID NO: 57;
(215) a targeting sequence comprising amino acids 40-130 of SEQ ID NO: 57;
(216) a targeting sequence comprising amino acids 50-130 of SEQ ID NO: 57;
(217) a targeting sequence comprising amino acids 60-130 of SEQ ID NO: 57;
(218) a targeting sequence comprising amino acids 70-130 of SEQ ID NO: 57;
(219) a targeting sequence comprising amino acids 80-130 of SEQ ID NO: 57;
(220) a targeting sequence comprising amino acids 90-130 of SEQ ID NO: 57;
(221) a targeting sequence comprising amino acids 100-130 of SEQ ID NO: 57;
(222) a targeting sequence comprising amino acids 110-130 of SEQ ID NO: 57;
(223) an exosporium protein fragment comprising an amino acid sequence having at least 85% identity with SEQ ID NO: 95;
(224) a targeting sequence comprising SEQ ID NO: 96;
(225) a targeting sequence comprising SEQ ID NO: 97;
(226) a targeting sequence comprising SEQ ID NO: 98;
(227) a targeting sequence comprising SEQ ID NO: 99;
(228) a targeting sequence comprising SEQ ID NO: 100;
(229) a targeting sequence comprising SEQ ID NO: 101;
(230) a targeting sequence comprising SEQ ID NO: 102;
(231) a targeting sequence comprising SEQ ID NO: 103;
(232) a targeting sequence comprising SEQ ID NO: 104;
(233) a targeting sequence comprising SEQ ID NO: 105;
(234) a targeting sequence comprising SEQ ID NO: 106;
(235) an exosporium protein comprising an amino acid sequence having at least 85% identity with SEQ ID NO: 108;
(236) an exosporium protein comprising an amino acid sequence having at least 85% identity with SEQ ID NO: 109;

(237) an exosporium protein comprising an amino acid sequence having at least 85% identity with SEQ ID NO: 110;
(238) an exosporium protein comprising an amino acid sequence having at least 85% identity with SEQ ID NO: 111;
(239) an exosporium protein comprising an amino acid sequence having at least 85% identity with SEQ ID NO: 112;
(240) an exosporium protein comprising an amino acid sequence having at least 85% identity with SEQ ID NO: 113;
(241) an exosporium protein comprising an amino acid sequence having at least 85% identity with SEQ ID NO: 114;
(242) an exosporium protein comprising an amino acid sequence having at least 85% identity with SEQ ID NO: 115;
(243) an exosporium protein comprising an amino acid sequence having at least 85% identity with SEQ ID NO: 116;
(244) an exosporium protein comprising an amino acid sequence having at least 85% identity with SEQ ID NO: 117;
(245) an exosporium protein comprising an amino acid sequence having at least 85% identity with SEQ ID NO: 118;
(246) an exosporium protein comprising an amino acid sequence having at least 85% identity with SEQ ID NO: 119;
(247) an exosporium protein comprising an amino acid sequence having at least 85% identity with SEQ ID NO: 120;
(248) an exosporium protein comprising an amino acid sequence having at least 85% identity with SEQ ID NO: 121;
(249) a targeting sequence comprising amino acids 22-31 of SEQ ID NO: 1;
(250) a targeting sequence comprising amino acids 22-33 of SEQ ID NO: 1;
(251) a targeting sequence comprising amino acids 20-31 of SEQ ID NO: 1;
(252) a targeting sequence comprising amino acids 14-23 of SEQ ID NO: 3;
(253) a targeting sequence comprising amino acids 14-25 of SEQ ID NO: 3;
(254) a targeting sequence comprising amino acids 12-23 of SEQ ID NO: 3;
(255) a targeting sequence comprising amino acids 1-30 of SEQ ID NO: 59;
(256) a targeting sequence comprising SEQ ID NO: 59;
(257) an exosporium protein comprising an amino acid sequence having at least 85% identity with SEQ ID NO: 60;
(258) a targeting sequence comprising amino acids 2-30 of SEQ ID NO: 59;
(259) a targeting sequence comprising amino acids 4-30 of SEQ ID NO: 59;
(260) a targeting sequence comprising amino acids 6-30 of SEQ ID NO: 59;
(261) a targeting sequence comprising amino acids 1-33 of SEQ ID NO: 61;
(262) a targeting sequence comprising amino acids 18-33 of SEQ ID NO: 61;
(263) a targeting sequence comprising SEQ ID NO: 61;
(264) an exosporium protein comprising an amino acid sequence having at least 85% sequence identity with SEQ ID NO: 62;
(265) a targeting sequence comprising amino acids 2-33 of SEQ ID NO: 61;
(266) a targeting sequence comprising amino acids 5-33 of SEQ ID NO: 61;
(267) a targeting sequence comprising amino acids 10-33 of SEQ ID NO: 61;
(268) a targeting sequence comprising amino acids 15-33 of SEQ ID NO: 61;
(269) a targeting sequence comprising amino acids 1-35 of SEQ ID NO: 63;
(270) a targeting sequence comprising SEQ ID NO: 63;
(271) an exosporium protein comprising an amino acid sequence having at least 85% identity with SEQ ID NO: 64;
(272) a targeting sequence comprising amino acids 2-35 of SEQ ID NO: 63;
(273) a targeting sequence comprising amino acids 5-35 of SEQ ID NO: 63;
(274) a targeting sequence comprising amino acids 8-35 of SEQ ID NO: 63;
(275) a targeting sequence comprising amino acids 10-35 of SEQ ID NO: 63;
(276) a targeting sequence comprising amino acids 15-35 of SEQ ID NO: 63;
(277) a targeting sequence comprising amino acids 1-24 of SEQ ID NO: 65;
(278) a targeting sequence comprising amino acids 9-24 of SEQ ID NO: 65;
(279) a targeting sequence comprising SEQ ID NO: 65;
(280) an exosporium protein comprising an amino acid sequence having at least 85% identity with SEQ ID NO: 66;
(281) a targeting sequence comprising SEQ ID NO: 107;
(282) a targeting sequence comprising amino acids 2-24 of SEQ ID NO: 65;
(283) a targeting sequence comprising amino acids 5-24 of SEQ ID NO: 65;
(284) a targeting sequence comprising amino acids 1-27 of SEQ ID NO: 67;
(285) a targeting sequence comprising amino acids 12-27 of SEQ ID NO: 67;
(286) a targeting sequence comprising SEQ ID NO: 67;
(287) an exosporium protein comprising an amino acid sequence having at least 85% identity with SEQ ID NO: 68;
(288) an targeting sequence comprising amino acids 2-27 of SEQ ID NO: 67;
(289) a targeting sequence comprising amino acids 5-27 of SEQ ID NO: 67;
(290) a targeting sequence comprising amino acids 10-27 of SEQ ID NO: 67;
(291) a targeting sequence comprising amino acids 1-38 of SEQ ID NO: 69;
(292) a targeting sequence comprising amino acids 23-38 of SEQ ID NO: 69;
(293) a targeting sequence comprising SEQ ID NO: 69;
(294) an exosporium protein comprising an amino acid sequence having at least 85% identity with SEQ ID NO: 70;
(295) a targeting sequence comprising amino acids 2-38 of SEQ ID NO: 69;
(296) a targeting sequence comprising amino acids 5-38 of SEQ ID NO: 69;

(297) a targeting sequence comprising amino acids 10-38 of SEQ ID NO: 69;
(298) a targeting sequence comprising amino acids 15-38 of SEQ ID NO: 69;
(299) an exosporium protein comprising SEQ ID NO: 72;
(300) a targeting sequence comprising SEQ ID NO: 73;
(301) an exosporium protein comprising an amino acid sequence having at least 95% identity with SEQ ID NO: 74;
(302) a targeting sequence comprising amino acids 1-42 of SEQ ID NO: 75;
(303) a targeting sequence comprising amino acids 27-42 of SEQ ID NO: 75;
(304) a targeting sequence comprising SEQ ID NO: 75;
(305) an exosporium protein comprising an amino acid sequence having at least 85% identity with SEQ ID NO: 76;
(306) a targeting sequence comprising amino acids 2-42 of SEQ ID NO: 75;
(307) a targeting sequence comprising amino acids 5-42 of SEQ ID NO: 75;
(308) a targeting sequence comprising amino acids 10-42 of SEQ ID NO: 75;
(309) a targeting sequence comprising amino acids 15-42 of SEQ ID NO: 75;
(310) a targeting sequence comprising amino acids 20-42 of SEQ ID NO: 75;
(311) a targeting sequence comprising amino acids 25-42 of SEQ ID NO: 75;
(312) a targeting sequence comprising amino acids 1-24 of SEQ ID NO: 77;
(313) a targeting sequence comprising amino acids 9-24 of SEQ ID NO: 77;
(314) a targeting sequence comprising SEQ ID NO: 77;
(315) an exosporium protein comprising an amino acid sequence having at least 85% identity with SEQ ID NO: 78;
(316) a targeting sequence comprising amino acids 2-24 of SEQ ID NO: 77;
(317) a targeting sequence comprising amino acids 5-24 of SEQ ID NO: 77;
(318) an exosporium protein comprising an amino acid sequence having at least 85% identity with SEQ ID NO: 80;
(319) a targeting sequence comprising amino acids 1-38 of SEQ ID NO: 81;
(320) a targeting sequence comprising amino acids 23-38 of SEQ ID NO: 81;
(321) a targeting sequence comprising SEQ ID NO: 81;
(322) an exosporium protein comprising an amino acid sequence having at least 85% identity with SEQ ID NO: 82;
(323) a targeting sequence comprising amino acids 2-38 of SEQ ID NO: 81;
(324) a targeting sequence comprising amino acids 5-38 of SEQ ID NO: 81;
(325) a targeting sequence comprising amino acids 10-38 of SEQ ID NO: 81;
(326) a targeting sequence comprising amino acids 15-38 of SEQ ID NO: 81;
(327) a targeting sequence comprising amino acids 20-38 of SEQ ID NO: 81;
(328) a targeting sequence comprising amino acids 1-34 of SEQ ID NO: 83;
(329) a targeting sequence comprising SEQ ID NO: 83;
(330) an exosporium protein comprising an amino acid sequence having at least 85% identity with SEQ ID NO: 84;
(331) an exosporium protein comprising an amino acid sequence having at least 85% identity with SEQ ID NO: 86;
(332) a targeting sequence comprising amino acids 1-28 of SEQ ID NO: 87;
(333) a targeting sequence comprising amino acids 13-28 of SEQ ID NO: 87;
(334) a targeting sequence comprising SEQ ID NO: 87;
(335) an exosporium protein comprising an amino acid sequence having at least 85% identity with SEQ ID NO: 88;
(336) a targeting sequence comprising amino acids 2-28 of SEQ ID NO: 87;
(337) a targeting sequence comprising amino acids 5-28 of SEQ ID NO: 87;
(338) a targeting sequence comprising amino acids 10-28 of SEQ ID NO: 87;
(339) a targeting sequence comprising amino acids 1-28 of SEQ ID NO: 89;
(340) a targeting sequence comprising SEQ ID NO: 89;
(341) an exosporium protein comprising an amino acid sequence having at least 85% identity with SEQ ID NO: 90;
(342) a targeting sequence comprising amino acids 2-28 of SEQ ID NO: 89;
(343) a targeting sequence comprising amino acids 5-28 of SEQ ID NO: 89;
(344) a targeting sequence comprising amino acids 10-28 of SEQ ID NO: 89;
(345) a targeting sequence comprising amino acids 1-93 of SEQ ID NO: 91;
(346) a targeting sequence comprising SEQ ID NO: 91;
(347) an exosporium protein comprising an amino acid sequence having at least 85% identity with SEQ ID NO: 92;
(348) a targeting sequence comprising amino acids 2-93 of SEQ ID NO: 91;
(349) a targeting sequence comprising amino acids 10-93 of SEQ ID NO: 91;
(350) a targeting sequence comprising amino acids 20-93 of SEQ ID NO: 91;
(351) a targeting sequence comprising amino acids 30-93 of SEQ ID NO: 91;
(352) a targeting sequence comprising amino acids 40-93 of SEQ ID NO: 91;
(353) a targeting sequence comprising amino acids 50-93 of SEQ ID NO: 91;
(354) a targeting sequence comprising amino acids 60-93 of SEQ ID NO: 91;
(355) a targeting sequence comprising amino acids 1-130 of SEQ ID NO: 93;
(356) a targeting sequence comprising SEQ ID NO: 93;
(357) an exosporium protein comprising an amino acid sequence having at least 85% identity with SEQ ID NO: 94;
(358) a targeting sequence comprising amino acids 2-130 of SEQ ID NO: 93;
(359) a targeting sequence comprising amino acids 10-130 of SEQ ID NO: 93;
(360) a targeting sequence comprising amino acids 20-130 of SEQ ID NO: 93;
(361) a targeting sequence comprising amino acids 30-130 of SEQ ID NO: 93;

(362) an exosporium protein comprising an amino acid sequence having at least 85% identity with SEQ ID NO: 122;
(363) a targeting sequence consisting of amino acids 20-33 of SEQ ID NO: 1;
(364) a targeting sequence consisting of amino acids 21-33 of SEQ ID NO: 1;
(365) a targeting sequence consisting of amino acids 23-31 of SEQ ID NO: 1;
(366) a targeting sequence consisting of amino acids 1-15 of SEQ ID NO: 96;
(367) a targeting sequence consisting of amino acids 1-13 of SEQ ID NO: 96;
(368) a targeting sequence consisting of amino acids 12-25 of SEQ ID NO: 3;
(369) a targeting sequence consisting of amino acids 13-25 of SEQ ID NO: 3;
(370) a targeting sequence consisting of amino acids 15-23 of SEQ ID NO: 3;
(371) a targeting sequence consisting of amino acids 1-15 of SEQ ID NO: 97;
(372) a targeting sequence consisting of amino acids 1-13 of SEQ ID NO: 98;
(373) a targeting sequence consisting of amino acids 23-36 of SEQ ID NO: 5;
(374) a targeting sequence consisting of amino acids 23-34 of SEQ ID NO: 5;
(375) a targeting sequence consisting of amino acids 24-36 of SEQ ID NO: 5;
(376) a targeting sequence consisting of amino acids 26-34 of SEQ ID NO: 5;
(377) a targeting sequence consisting of amino acids 13-26 of SEQ ID NO: 7;
(378) a targeting sequence consisting of amino acids 13-24 of SEQ ID NO: 7;
(379) a targeting sequence consisting of amino acids 14-26 of SEQ ID NO: 7;
(380) a targeting sequence consisting of amino acids 16-24 of SEQ ID NO: 7;
(381) a targeting sequence consisting of amino acids 9-22 of SEQ ID NO: 9;
(382) a targeting sequence consisting of amino acids 9-20 of SEQ ID NO: 9;
(383) a targeting sequence consisting of amino acids 10-22 of SEQ ID NO: 9;
(384) a targeting sequence consisting of amino acids 12-20 of SEQ ID NO: 9;
(385) a targeting sequence consisting of amino acids 1-15 of SEQ ID NO: 105;
(386) a targeting sequence consisting of amino acids 1-13 of SEQ ID NO: 105;
(387) a targeting sequence consisting of amino acids 18-31 of SEQ ID NO: 11;
(388) a targeting sequence consisting of amino acids 18-29 of SEQ ID NO: 11;
(389) a targeting sequence consisting of amino acids 19-31 of SEQ ID NO: 11;
(390) a targeting sequence consisting of amino acids 1-15 of SEQ ID NO: 98;
(391) a targeting sequence consisting of amino acids 1-13 of SEQ ID NO: 98;
(392) a targeting sequence consisting of amino acids 18-31 of SEQ ID NO: 13;
(393) a targeting sequence consisting of amino acids 18-29 of SEQ ID NO: 13;
(394) a targeting sequence consisting of amino acids 19-31 of SEQ ID NO: 13;
(395) a targeting sequence consisting of amino acids 21-29 of SEQ ID NO: 13;
(396) a targeting sequence consisting of amino acids 1-15 of SEQ ID NO: 99;
(397) a targeting sequence consisting of amino acids 1-13 of SEQ ID NO: 99;
(398) a targeting sequence consisting of amino acids 28-41 of SEQ ID NO: 15;
(399) a targeting sequence consisting of amino acids 28-39 of SEQ ID NO: 15;
(400) a targeting sequence consisting of amino acids 29-41 of SEQ ID NO: 15;
(401) a targeting sequence consisting of amino acids 31-39 of SEQ ID NO: 15;
(402) a targeting sequence consisting of amino acids 12-25 of SEQ ID NO: 17;
(403) a targeting sequence consisting of amino acids 13-25 of SEQ ID NO: 17;
(404) a targeting sequence consisting of amino acids 1-15 of SEQ ID NO: 100;
(405) a targeting sequence consisting of amino acids 18-31 of SEQ ID NO: 19;
(406) a targeting sequence consisting of amino acids 18-29 of SEQ ID NO: 19;
(407) a targeting sequence consisting of amino acids 19-31 of SEQ ID NO: 19;
(408) a targeting sequence consisting of amino acids 21-29 of SEQ ID NO: 19;
(409) a targeting sequence consisting of amino acids 18-31 of SEQ ID NO: 21;
(410) a targeting sequence consisting of amino acids 18-29 of SEQ ID NO: 21;
(411) a targeting sequence consisting of amino acids 19-31 of SEQ ID NO: 21;
(412) a targeting sequence consisting of amino acids 21-29 of SEQ ID NO: 21;
(413) a targeting sequence consisting of amino acids 1-15 of SEQ ID NO: 101;
(414) a targeting sequence consisting of amino acids 1-13 of SEQ ID NO: 101;
(415) a targeting sequence consisting of amino acids 9-22 of SEQ ID NO: 23;
(416) a targeting sequence consisting of amino acids 9-20 of SEQ ID NO: 23;
(417) a targeting sequence consisting of amino acids 10-22 of SEQ ID NO: 23;
(418) a targeting sequence consisting of amino acids 12-20 of SEQ ID NO: 23;
(419) a targeting sequence consisting of amino acids 1-15 of SEQ ID NO: 102;
(420) a targeting sequence consisting of amino acids 1-13 of SEQ ID NO: 102;
(421) a targeting sequence consisting of amino acids 9-22 of SEQ ID NO: 25;
(422) a targeting sequence consisting of amino acids 9-20 of SEQ ID NO: 25;
(423) a targeting sequence consisting of amino acids 10-22 of SEQ ID NO: 25;
(424) a targeting sequence consisting of amino acids 12-20 of SEQ ID NO: 25;
(425) a targeting sequence consisting of amino acids 1-15 of SEQ ID NO: 103;
(426) a targeting sequence consisting of amino acids 1-13 of SEQ ID NO: 103;
(427) a targeting sequence consisting of amino acids 15-28 of SEQ ID NO: 27;

(428) a targeting sequence consisting of amino acids 15-26 of SEQ ID NO: 27;
(429) a targeting sequence consisting of amino acids 16-28 of SEQ ID NO: 27;
(430) a targeting sequence consisting of amino acids 18-26 of SEQ ID NO: 27;
(431) a targeting sequence consisting of amino acids 1-15 of SEQ ID NO: 104;
(432) a targeting sequence consisting of amino acids 1-13 of SEQ ID NO: 104;
(433) a targeting sequence consisting of amino acids 1-13 of SEQ ID NO: 33;
(434) a targeting sequence consisting of amino acids 1-11 of SEQ ID NO: 33;
(435) a targeting sequence consisting of amino acids 3-11 of SEQ ID NO: 33;
(436) a targeting sequence consisting of amino acids 1-14 of SEQ ID NO: 35;
(437) a targeting sequence consisting of amino acids 1-12 of SEQ ID NO: 35;
(438) a targeting sequence consisting of amino acids 2-14 of SEQ ID NO: 35;
(439) a targeting sequence consisting of amino acids 14-27 of SEQ ID NO: 43;
(440) a targeting sequence consisting of amino acids 14-25 of SEQ ID NO: 43;
(441) a targeting sequence consisting of amino acids 15-27 of SEQ ID NO: 43;
(442) a targeting sequence consisting of amino acids 20-33 of SEQ ID NO: 45;
(443) a targeting sequence consisting of amino acids 20-31 of SEQ ID NO: 45;
(444) a targeting sequence consisting of amino acids 21-33 of SEQ ID NO: 45;
(445) a targeting sequence consisting of amino acids 1-15 of SEQ ID NO: 106;
(446) a targeting sequence consisting of amino acids 1-13 of SEQ ID NO: 106;
(447) a targeting sequence consisting of amino acids 28-41 of SEQ ID NO: 47;
(448) a targeting sequence consisting of amino acids 28-39 of SEQ ID NO: 47;
(449) a targeting sequence consisting of amino acids 18-31 of SEQ ID NO: 53;
(450) a targeting sequence consisting of amino acids 18-29 of SEQ ID NO: 53;
(451) a targeting sequence consisting of amino acids 19-31 of SEQ ID NO: 53;
(452) a targeting sequence comprising amino acids 18-31 of SEQ ID NO: 61;
(453) a targeting sequence comprising amino acids 18-29 of SEQ ID NO: 61;
(454) a targeting sequence comprising amino acids 19-31 of SEQ ID NO: 61;
(455) a targeting sequence comprising amino acids 9-22 of SEQ ID NO: 65;
(456) a targeting sequence comprising amino acids 9-20 of SEQ ID NO: 65;
(457) a targeting sequence comprising amino acids 10-22 of SEQ ID NO: 65;
(458) a targeting sequence comprising amino acids 1-15 of SEQ ID NO: 107;
(459) a targeting sequence comprising amino acids 1-13 of SEQ ID NO: 107;
(460) a targeting sequence comprising amino acids 12-25 of SEQ ID NO: 67;
(461) a targeting sequence comprising amino acids 12-23 of SEQ ID NO: 67;
(462) a targeting sequence comprising amino acids 13-25 of SEQ ID NO: 67;
(463) a targeting sequence comprising amino acids 15-23 of SEQ ID NO: 67;
(464) a targeting sequence comprising amino acids 23-36 of SEQ ID NO: 69;
(465) a targeting sequence comprising amino acids 23-34 of SEQ ID NO: 69;
(466) a targeting sequence comprising amino acids 24-36 of SEQ ID NO: 69;
(467) a targeting sequence comprising amino acids 26-34 of SEQ ID NO: 69;
(468) a targeting sequence comprising amino acids 27-40 of SEQ ID NO: 75;
(469) a targeting sequence comprising amino acids 27-38 of SEQ ID NO: 75;
(470) a targeting sequence comprising amino acids 9-22 of SEQ ID NO: 77;
(471) a targeting sequence comprising amino acids 9-20 of SEQ ID NO: 77;
(472) a targeting sequence comprising amino acids 10-22 of SEQ ID NO: 77;
(473) a targeting sequence comprising amino acids 12-20 of SEQ ID NO: 77;
(474) a targeting sequence comprising amino acids 23-36 of SEQ ID NO: 81;
(475) a targeting sequence comprising amino acids 23-34 of SEQ ID NO: 81;
(476) a targeting sequence comprising amino acids 24-36 of SEQ ID NO: 81;
(477) a targeting sequence comprising amino acids 26-34 of SEQ ID NO: 81;
(478) a targeting sequence comprising amino acids 13-26 of SEQ ID NO: 87;
(479) a targeting sequence comprising amino acids 13-24 of SEQ ID NO: 87;
(480) a targeting sequence comprising amino acids 14-26 of SEQ ID NO: 87;
(481) a targeting sequence comprising SEQ ID NO: 371;
(482) a targeting sequence comprising SEQ ID NO: 372
(483) an exosporium protein comprising an amino acid sequence having at least 85% identity with SEQ ID NO: 381;
(484) an exosporium protein comprising an amino acid sequence having at least 85% identity with SEQ ID NO: 382;
(485) an exosporium protein fragment comprising an amino acid sequence having at least 85% identity with SEQ ID NO: 383;
(486) an exosporium protein comprising an amino acid sequence having at least 85% identity with SEQ ID NO: 384; or
(487) an exosporium protein fragment comprising an amino acid sequence having at least 85% identity with SEQ ID NO:385.

Embodiment 227 is a fusion protein, a recombinant *Bacillus cereus* family member, exosporium fragments, a formulation, a seed, an animal feed additive, an animal feed composition, or a method of embodiment 226, wherein the targeting sequence comprises:

an amino acid sequence having at least about 50% identity with amino acids 20-35 of SEQ ID NO: 1, wherein the identity with amino acids 25-35 is at least about 63%;

an amino acid sequence having at least about 50% identity with amino acids 20-35 of SEQ ID NO: 1, wherein the identity with amino acids 25-35 is at least about 72%;

an amino acid sequence having at least about 56% identity with amino acids 20-35 of SEQ ID NO: 1, wherein the identity with amino acids 25-35 is at least about 63%;

an amino sequence having at least about 62% identity with amino acids 20-35 of SEQ ID NO: 1, wherein the identity with amino acids 25-35 is at least about 72%;

an amino acid sequence having at least about 68% identity with amino acids 20-35 of SEQ ID NO: 1, wherein the identity with amino acids 25-35 is at least about 81%;

an amino sequence having at least about 75% identity with amino acids 20-35 of SEQ ID NO: 1, wherein the identity with amino acids 25-35 is at least about 72%;

an amino sequence having at least about 75% identity with amino acids 20-35 of SEQ ID NO: 1, wherein the identity with amino acids 25-35 is at least about 81%;

an amino acid sequence having at least about 81% identity with amino acids 20-35 of SEQ ID NO:1, wherein the identity with amino acids 25-35 is at least about 81%; or an amino acid sequence having at least about 81% identity with amino acids 20-35 of SEQ ID NO: 1, wherein the identity with amino acids 25-35 is at least about 90%.

Embodiment 228 is a fusion protein, a recombinant *Bacillus cereus* family member, exosporium fragments, a formulation, a seed, an animal feed additive, an animal feed composition, or a method of embodiment 227, wherein the targeting sequence consists of the amino acid sequence.

Embodiment 229 is a fusion protein, a recombinant *Bacillus cereus* family member, exosporium fragments, a formulation, a seed, an animal feed additive, an animal feed composition, or a method of embodiment 226, wherein the targeting sequence consists of:
(a) an amino acid sequence consisting of 16 amino acids and having at least about 43% identity with amino acids 20-35 of SEQ ID NO: 1, wherein the identity with amino acids 25-35 is at least about 54%;
(b) amino acids 1-35 of SEQ ID NO: 1;
(c) amino acids 20-35 of SEQ ID NO: 1;
(d) SEQ ID NO: 1;
(e) SEQ ID NO: 96; or
(f) SEQ ID NO: 120.

Embodiment 230 is a fusion protein, a recombinant *Bacillus cereus* family member, exosporium fragments, a formulation, a seed, an animal feed additive, an animal feed composition, or a method of embodiment 226, wherein the fusion protein comprises an exosporium protein or an exosporium protein fragment comprising an amino acid sequence having at least 90%, at least 95%, at least 98%, at least 99%, or 100% identity any one of with SEQ ID NOs. 2, 4, 6, 8, 10, 12, 14, 16, 18, 20, 22, 24, 26, 28, 30, 32, 34, 36, 44, 46, 48, 50, 52, 54, 56, 58, 95, 108, 109, 110, 111, 112, 113, 114, 115, 116, 117, 118, 119, 120, and 121.

Embodiment 231 is a fusion protein, a recombinant *Bacillus cereus* family member, exosporium fragments, a formulation, a seed, an animal feed additive, an animal feed composition, or a method of embodiment 226, wherein the fusion protein comprises an exosporium protein comprising an amino acid sequence having at least 90%, at least 95%, at least 98%, at least 99%, or 100% identity with SEQ ID NO: 60, 62, 64, 66, 68, 70, 76, 78, 80, 82, 84, 86, 88, 90, 92, 94, or 122.

Embodiment 232 is a fusion protein, a recombinant *Bacillus cereus* family member, exosporium fragments, a formulation, a seed, an animal feed additive, an animal feed composition, or a method of embodiment 226, wherein the fusion protein comprises an exosporium protein or an exosporium protein fragment comprising an amino acid sequence having at least 90%, at least 95%, at least 98%, at least 99%, or 100% identity any one of with SEQ ID NOs. 381-385.

Embodiment 233 is a fusion protein of any one of embodiments 1-73, 182-190, and 225-232, a recombinant *Bacillus cereus* family member of any one of embodiments 74, 182-192, 194-200, and 225-232, exosporium fragments of any one of embodiments 75, 182-192, and 194-232, a formulation of any one of embodiments 76-88, 114, 115, 118, 130-132, 135-148, 182-192, and 194-232, a seed of any one of embodiments 89-92, 114, 115, 118, 130-132, 143, 148, 182-192, and 194-232, an animal feed additive of any one of embodiments 93, 94, 97-100, and 182-232, an animal feed composition of any one of embodiments 95-106 and 182-232, or a method of any one of embodiments 107-232, wherein the targeting sequence, exosporium protein, or exosporium protein fragment comprises the amino acid sequence GXT at its carboxy terminus, wherein X is any amino acid.

Embodiment 234 is a fusion protein of any one of embodiments 1-73, 182-190, and 225-233, a recombinant *Bacillus cereus* family member of any one of embodiments 74, 182-192, 194-200, and 225-233, exosporium fragments of any one of embodiments 75, 182-192, and 194-233, a formulation of any one of embodiments 76-88, 114, 115, 118, 130-132, 135-148, 182-192, and 194-233, a seed of any one of embodiments 89-92, 114, 115, 118, 130-132, 143, 148, 182-192, and 194-233, an animal feed additive of any one of embodiments 93, 94, 97-100, and 182-233, an animal feed composition of any one of embodiments 95-106 and 182-233, or a method of any one of embodiments 107-233, wherein the targeting sequence, exosporium protein, or exosporium protein fragment comprises an alanine residue at the position of the targeting sequence that corresponds to amino acid 20 of SEQ ID NO: 1.

Embodiment 235 is a fusion protein of any one of embodiments 1-73, 182-190, and 225-234, a recombinant *Bacillus cereus* family member of any one of embodiments 74, 182-192, 194-200, and 225-234, exosporium fragments of any one of embodiments 75, 182-192, and 194-234, a formulation of any one of embodiments 76-88, 114, 115, 118, 130-132, 135-148, 182-192, and 194-234, a seed of any one of embodiments 89-92, 114, 115, 118, 130-132, 143, 148, 182-192, and 194-234, an animal feed additive of any one of embodiments 93, 94, 97-100, and 182-234, an animal feed composition of any one of embodiments 95-106 and 182-234, or a method of any one of embodiments 107-234, wherein the targeting sequence, exosporium protein, or exosporium protein fragment further comprises a methionine, serine, or threonine residue at the amino acid position immediately preceding the first amino acid of the targeting sequence, exosporium protein, or exosporium protein fragment or at the position of the targeting sequence that corresponds to amino acid 20 of SEQ ID NO: 1.

Embodiment 236 is a fusion protein of any one of embodiments 1-73, 182-190, and 225-235, a recombinant *Bacillus cereus* family member of any one of embodiments 74, 182-192, 194-200, and 225-235, exosporium fragments of any one of embodiments 75, 182-192, and 194-235, a formulation of any one of embodiments 76-88, 114, 115, 118, 130-132, 135-148, 182-192, and 194-235, a seed of any one of embodiments 89-92, 114, 115, 118, 130-132, 143, 148, 182-192, and 194-235, an animal feed additive of any one of embodiments 95-106 and 182-235, an animal feed composition of any one of embodiments 95-106 and 182-235, or a method of any one of embodiments 107-235, wherein the fusion protein further comprises an amino acid linker between the targeting sequence, the exosporium protein, or the exosporium protein fragment and the enzyme having ACC deaminase activity, the phospholipase, the lipase, the xylanase, the xylosidase, the lactonase, the chitosanase, the protease, the glucanase, the expansin protein, the phytase, the acid phosphatase, the pectinase, or the mannanase.

Embodiment 237 is a fusion protein, a recombinant *Bacillus cereus* family member, exosporium fragments, a formulation, a seed, an animal feed additive, an animal feed composition, or a method of embodiment 236, wherein the linker comprises a polyalanine linker, a polyglycine linker, or a linker comprising a mixture of both alanine and glycine residues.

Embodiment 238 is a fusion protein, a recombinant *Bacillus cereus* family member, exosporium fragments, a formulation, a seed, an animal feed additive, an animal feed composition, or a method of embodiment 236 or 237, wherein the linker comprises a protease recognition site.

Embodiment 239 is a recombinant *Bacillus cereus* family member of any one of embodiments 74, 182-192, 194-200, and 225-238, exosporium fragments of any one of embodiments 75, 182-192, and 194-238, a formulation of any one of embodiments 76-88, 114, 115, 118, 130-132, 135-148, 182-192, and 194-238, a seed of any one of embodiments 89-92, 114, 115, 118, 130-132, 143, 148, 182-192, and 194-238, an animal feed additive of any one of embodiments 95-106 and 182-238, an animal feed composition of any one of embodiments 95-106 and 182-238, or a method of any one of embodiments 107-238, wherein the fusion protein is expressed under the control of a sporulation promoter native to the targeting sequence, exosporium protein, or exosporium protein fragment of the fusion protein or a portion thereof.

Embodiment 240 is a recombinant *Bacillus cereus* family member of any one of embodiments 74, 182-192, 194-200, and 225-238, exosporium fragments of any one of embodiments 75, 182-192, and 194-238, a formulation of any one of embodiments 76-88, 114, 115, 118, 130-132, 135-148, 182-192, and 194-238, a seed of any one of embodiments 89-92, 114, 115, 118, 130-132, 143, 148, 182-192, and 194-238, an animal feed additive of any one of embodiments 95-106 and 182-238, an animal feed composition of any one of embodiments 95-106 and 182-238, or a method of any one of embodiments 107-238, wherein the fusion protein is expressed under the control of a high-expression sporulation promoter.

Embodiment 241 is a recombinant *Bacillus cereus* family member, exosporium fragments, a formulation, a seed, an animal feed additive, an animal feed composition, or a method of embodiment 240, wherein the high-expression sporulation promoter comprises a sigma-K sporulation-specific polymerase promoter sequence.

Embodiment 242 is a recombinant *Bacillus cereus* family member, exosporium fragments, a formulation, a seed, an animal feed additive, an animal feed composition, or a method of any one of embodiments 239-241, wherein the sporulation promoter comprises a nucleic acid sequence having at least 80%, at least 85%, at least 90%, at least 95%, at least 98%, at least 99% or 100% identity with a nucleic acid sequence of any one of SEQ ID NOs: 37-42 and 123-191.

Embodiment 243 is a recombinant *Bacillus cereus* family member, exosporium fragments, a formulation, a seed, an animal feed additive, an animal feed composition, or a method of any one of embodiments 239-241, wherein the promoter comprises a nucleic acid sequence having at least 80%, at least 85%, at least 90%, at least 95%, at least 98%, at least 99%, or 100% sequence identity with SEQ ID NO: 37, 38, 41, 42, 149, 150, 175, 180, 181, 185, 189, or 190.

Embodiment 244 is a recombinant *Bacillus cereus* family member, exosporium fragments, a formulation, a seed, an animal feed additive, an animal feed composition, or a method of 242 or 243, wherein the sigma-K sporulation-specific polymerase promoter sequence or sequences have 100% identity with the corresponding nucleotides of any of SEQ ID NOs: 37-42 and 123-191.

Embodiment 245 is a formulation of any one of embodiments 88, 114, 115, 118, 130-132, 135-148, 182-200, and 194-244, a seed of any one of embodiments 91, 92, 114, 115, 118, 130-132, 143, 148, 182-200, and 194-244, or a method of any one of embodiments 107-120, 149-172 and 182-244, wherein the fertilizer comprises nitrogen, phosphate, potassium, zinc, iron, selenium, boron, copper, or a combination of any thereof.

Embodiment 246 is a formulation, seed, or method of embodiment 245, wherein the phosphate comprises monoammonium phosphate, diammonium phosphate, orthophosphate, orthopolyphosphate, or a combination of any thereof; or wherein the potassium comprises potassium acetate.

Embodiment 247 is a formulation, seed, or method of embodiment 245, wherein the fertilizer comprises 12% ammoniacal nitrogen and 58% available phosphate.

Embodiment 248 is a formulation of any one of embodiments 88, 114, 115, 118, 130-132, 135-148, 182-200, and 194-247, a seed of any one of embodiments 91, 92, 114, 115, 118, 130-132, 143, 148, 182-200, and 194-247, or a method of any one of embodiments 107-120, 149-172 and 182-247, wherein the biostimulant comprises a gibberellic acid, an indole-3-butyric acid, a kinetin, an auxin, an auxin homolog or derivative, or a combination of any thereof.

Embodiment 249 is a formulation of any one of embodiments 88, 114, 115, 118, 130-132, 135-148, 182-200, and 194-248, a seed of any one of embodiments 91, 92, 114, 115, 118, 130-132, 143, 148, 182-200, and 194-248, or a method of any one of embodiments 107-120, 149-172 and 182-248, wherein the formulation comprises a fertilizer, a biostimulant, or a combination thereof or wherein the method further comprises applying a fertilizer, a biostimulant, or a combination thereof to the plant growth medium, the plant, the plant seed, or the area surrounding the plant or the plant seed, and wherein the fusion protein comprises an acid phosphatase, a phospholipase, a mannanase, a glucanase, or a combination of any thereof.

Embodiment 250 is a formulation of any one of embodiments 76-88, 114, 115, 118, 130-132, 135-148, 182-200, and 194-249, a seed of any one of 91, 92, 114, 115, 118, 130-132, 143, 148, 182-200, and 194-249, or a method of any one of embodiments 107-120, 149-172 and 182-249, wherein the agriculturally acceptable carrier comprises a dispersant, a surfactant, an additive, water, a thickener, an anti-caking agent, a residue breakdown product, a composting formulation, a granular application, diatomaceous earth, an oil, a coloring agent, a stabilizer, a preservative, a polymer, a coating, or a combination of any thereof.

Embodiment 251 is a formulation, seed, or method of embodiment 250, wherein the agriculturally acceptable carrier comprises an additive, and the additive comprises an oil, a gum, a resin, a clay, a polyoxyethylene glycol, a terpene, a viscid organic, a fatty acid ester, a sulfated alcohol, an alkyl sulfonate, a petroleum sulfonate, an alcohol sulfate, a sodium alkyl butane diamate, a polyester of sodium thiobutane dioate, a benzene acetonitrile derivative, a proteinaceous material, or a combination of any thereof the agriculturally acceptable carrier comprises a thickener, and the thickener comprises a long chain alkylsulfonate of polyethylene glycol, a polyoxyethylene oleate, or a combination of any thereof the agriculturally acceptable carrier comprises a surfactant, and the surfactant comprises a heavy petroleum oil, a heavy petroleum distillate, a polyol fatty acid ester, a polyethoxylated fatty acid ester, an aryl alkyl polyoxyethylene glycol, an alkyl amine acetate, an alkyl aryl sulfonate, a polyhydric alcohol, an alkyl phosphate, or a combination of any thereof or the agriculturally acceptable carrier comprises an anti-caking agent, and the anti-caking agent comprises a sodium salt, a calcium carbonate, diatomaceous earth, or a combination of any thereof.

Embodiment 252 is a formulation, seed, or method of embodiment 250, wherein the surfactant comprises a non-ionic surfactant.

Embodiment 253 is a formulation, seed, or method of embodiment 251, wherein the additive comprises a proteinaceous material, and the proteinaceous material comprises a milk product, wheat flour, soybean meal, blood, albumin, gelatin, alfalfa meal, yeast extract, or a combination of any thereof or the anti-caking agent comprises a sodium salt, and the sodium salt comprises a sodium salt of monomethyl naphthalene sulfonate, a sodium salt of dimethyl naphthalene sulfonate, a sodium sulfite, a sodium sulfate, or a combination of any thereof.

Embodiment 254 is a formulation of any one of embodiments 76-88, 114, 115, 118, 130-132, 135-148, 182-200, and 194-253, a seed of any one of embodiments 91, 92, 114, 115, 118, 130-132, 143, 148, 182-200, and 194-253, or a method of any one of embodiments 107-120, 149-172 and 182-253, wherein the agriculturally acceptable carrier comprises vermiculite, charcoal, sugar factory carbonation press mud, rice husk, carboxymethyl cellulose, peat, perlite, fine sand, calcium carbonate, flour, alum, a starch, talc, polyvinyl pyrrolidone, or a combination of any thereof.

Embodiment 255 is a formulation of any one of embodiments 76-88, 114, 115, 118, 130-132, 135-148, 182-200, and 194-254, a seed of any one of embodiments 91, 92, 114, 115, 118, 130-132, 143, 148, 182-200, and 194-254, or a method of any one of embodiments 107-120, 149-172 and 182-254, wherein the formulation comprises a seed coating formulation, a liquid formulation for application to plants or to a plant growth medium, or a solid formulation for application to plants or to a plant growth medium.

Embodiment 256 is a formulation, seed, or method of embodiment 255, wherein the seed coating formulation comprises an aqueous or oil-based solution for application to seeds or a powder or granular formulation for application to seeds.

Embodiment 257 is a formulation, seed, or method of embodiment 255, wherein the liquid formulation for application to plants or to a plant growth medium comprises a concentrated formulation or a ready-to-use formulation.

Embodiment 258 is a formulation, seed, or method of embodiment 255, wherein the solid formulation for application to plants or to a plant growth medium comprises a granular formulation or a powder agent.

Embodiment 259 is a formulation of any one of embodiments 76-88, 114, 115, 118, 130-132, 135-148, 182-200, and 194-258, a seed of any one of embodiments 91, 92, 114, 115, 118, 130-132, 143, 148, 182-200, and 194-258, or a method of any one of embodiments 107-120, 149-172 and 182-258, wherein the agrochemical comprises a fertilizer, a micronutrient fertilizer material, an insecticide, a nematicide, an herbicide, a plant growth amendment, a fungicide, an insecticide, a molluscicide, an algicide, a bacterial inoculant, a fungal inoculant, a plant hormone, or a combination of any thereof.

Embodiment 260 is a formulation, seed, or method of embodiment 259, wherein the bacterial inoculant comprises a plant-growth promoting strain of bacteria, an endophytic strain of bacteria, or a strain of bacteria that is both plant-growth promoting and endophytic.

Embodiment 261 is a formulation, seed, or method of embodiment 260, wherein the strain of bacteria produces an insecticidal toxin, produces a fungicidal compound, produces a nematicidal compound, produces a bacteriocidal compound, is resistant to one or more antibiotics, comprises one or more freely replicating plasmids, binds to plant roots, colonizes plant roots, forms biofilms, solubilizes nutrients, secretes organic acids, or a combination of any thereof.

Embodiment 262 is a formulation, seed, or method of embodiment 261, wherein the insecticidal toxin comprises a Cry toxin; wherein the fungicidal compound comprises a β-1,3-glucanase, a chitosanase, a lyticase, or a combination of any thereof or wherein the nematicidal compound comprises a Cry toxin.

Embodiment 263 is a formulation, seed, or method of any one of embodiments 260-262, wherein the strain comprises *Bacillus aryabhattai* CAP53 (NRRL No. B-50819), *Bacillus aryabhattai* CAP56 (NRRL No. B-50817), *Bacillus flexus* BT054 (NRRL No. B-50816), *Paracoccus kondratievae* NC35 (NRRL No. B-50820), *Bacillus mycoides* BT155 (NRRL No. B-50921), *Enterobacter cloacae* CAP12 (NRRL No. B-50822), *Bacillus nealsonii* BOBA57 (NRRL No. NRRL B-50821), *Bacillus mycoides* EE118 (NRRL No. B-50918), *Bacillus subtilis* EE148 (NRRL No. B-50927), *Alcaligenes faecalis* EE107 (NRRL No. B-50920), *Bacillus mycoides* EE141 (NRRL NO. B-50916), *Bacillus mycoides* BT46-3 (NRRL No. B-50922), *Bacillus cereus* family member EE128 (NRRL No. B-50917), *Paenibacillus massiliensis* BT23 (NRRL No. B-50923), *Bacillus cereus* family member EE349 (NRRL No. B-50928), *Bacillus subtilis* EE218 (NRRL No. B-50926), *Bacillus megaterium* EE281 (NRRL No. B-50925), *Bacillus cereus* family member EE-B00377 (NRRL B-67119); *Bacillus pseudomycoides* EE-B00366 (NRRL B-67120), *Bacillus mycoides* EE-B00363 (NRRL B-67121), *Bacillus pumilus* EE-B00143 (NRRL B-67123), *Bacillus thuringiensis* EE-B00184 (NRRL B-67122), *Bacillus mycoides* EE116 (NRRL No. B-50919), *Bacillus cereus* family member EE417 (NRRL No. B-50974), *Lysinibacillus fusiformis* EE442 (NRRL No. B-50975), *Lysinibcaillus sphaericus* EE443 (NRRL No. B-50976), *Bacillus cereus* family member EE444 (NRRL No. B-50977), *Bacillus subtilis* EE405 (NRRL No. B-50978), *Bacillus cereus* family member EE439 (NRRL No. B-50979), *Bacillus megaterium* EE385 (NRRL No. B-50980), *Bacillus* species EE387 (NRRL No. B-50981), *Bacillus circulans* EE388 (NRRL No. B-50982), *Bacillus thuringiensis* EE319 (NRRL No. B-50983), *Bacillus thuringiensis* BT013A (NRRL No. B-50924), or a combination of any thereof.

Embodiment 264 is a formulation, seed, or method of any one of embodiments 259-263, wherein the agrochemical comprises a fertilizer, and the fertilizer comprises a liquid or a dry fertilizer; wherein the agrochemical comprises a micronutrient fertilizer material and the micronutrient fertilizer material comprises boric acid, a borate, a boron frit, copper sulfate, a copper frit, a copper chelate, a sodium tetraborate decahydrate, an iron sulfate, an iron oxide, iron ammonium sulfate, an iron frit, an iron chelate, a manganese sulfate, a manganese oxide, a manganese chelate, a manganese chloride, a manganese frit, a sodium molybdate, molybdic acid, a zinc sulfate, a zinc oxide, a zinc carbonate, a zinc frit, zinc phosphate, a zinc chelate, or a combination of any thereof wherein the agrochemical comprises an insecticide, and the insecticide comprises an organophosphate, a carbamate, a pyrethroid, an acaricide, an alkyl phthalate, boric acid, a borate, a fluoride, sulfur, a haloaromatic substituted urea, a hydrocarbon ester, a biologically-based insecticide, or a combination of any thereof; wherein the agrochemical comprises an herbicide, and the herbicide comprises a chlorophenoxy compound, a nitrophenolic compound, a nitrocresolic compound, a dipyridyl compound, an acetamide, an aliphatic acid, an anilide, a benzamide, a benzoic acid, a benzoic acid derivative, anisic acid, an anisic acid derivative, a benzonitrile, benzothiadiazinone dioxide, a thiocarbamate, a carbamate, a carbanilate, chloropyridinyl, a cyclohexenone derivative, a dinitroaminobenzene derivative, a fluorodinitrotoluidine compound, isoxazolidinone, nicotinic acid, isopropylamine, an isopropylamine derivative, oxadiazolinone, a phosphate, a phthalate, a picolinic acid compound, a triazine, a triazole, a uracil, a urea derivative, endothall, sodium chlorate, or a combination of any thereof; wherein the agrochemical comprises a fungicide, and the fungicide comprises a substituted benzene, a thiocarbamate, an ethylene bis dithiocarbamate, a thiophthalidamide, a copper compound, an organomercury compound, an organotin compound, a cadmium compound, anilazine, benomyl, cyclohexamide, dodine, etridiazole, iprodione, metlaxyl, thiamimefon, triforine, or a combination of any thereof; wherein the agrochemical comprises a fungal inoculant and the fungal inoculant comprises a fungal inoculant of the family Glomeraceae, a fungal inoculant of the family Claroidoglomeraceae, a fungal inoculant of the family Gigasporaceae, a fungal inoculant of the family Acaulosporaceae, a fungal inoculant of the family Sacculosporaceae, a fungal inoculant of the family Entrophosporaceae, a fungal inoculant of the family Pacidsporaceae, a fungal inoculant of the family Diversisporaceae, a fungal inoculant of the family Paraglomeraceae, a fungal inoculant of the family Archaeosporaceae, a fungal inoculant of the family Geosiphonaceae, a fungal inoculant of the family Ambisporaceae, a fungal inoculant of the family Scutellosporaceae, a fungal inoculant of the family Dentiscultataceae, a fungal inoculant of the family Racocetraceae, a fungal inoculant of the phylum Basidiomycota, a fungal inoculant of the phylum Ascomycota, a fungal inoculant of the phylum Zygomycota, or a combination of any thereof; or wherein the agrochemical comprises a bacterial inoculant and the bacterial inoculant comprises a bacterial inoculant of the genus *Rhizobium*, a bacterial inoculant of the genus *Bradyrhizobium*, a bacterial inoculant of the genus *Mesorhizobium*, a bacterial inoculant of the genus *Azorhizobium*, a bacterial inoculant of the genus *Allorhizobium*, a bacterial inoculant of the genus *Sinorhizobium*, a bacterial inoculant of the genus *Kluyvera*, a bacterial inoculant of the genus *Azotobacter*, a bacterial inoculant of the genus *Pseudomonas*, a bacterial inoculant of the genus *Azospirillium*, a bacterial inoculant of the genus *Bacillus*, a bacterial inoculant of the genus *Streptomyces*, a bacterial inoculant of the genus *Paenibacillus*, a bacterial inoculant of the genus *Paracoccus*, a bacterial inoculant of the genus *Enterobacter*, a bacterial inoculant of the genus *Alcaligenes*, a bacterial inoculant of the genus *Mycobacterium*, a bacterial inoculant of the genus *Trichoderma*, a bacterial inoculant of the genus *Gliocladium*, a bacterial inoculant of the genus *Glomus*, a bacterial inoculant of the genus *Klebsiella*, or a combination of any thereof.

Embodiment 265 is a formulation, seed, or method of any one of embodiments 259-264, wherein the agrochemical comprises a fungicide, and the fungicide comprises aldimorph, ampropylfos, ampropylfos potassium, andoprim, anilazine, azaconazole, azoxystrobin, benalaxyl, benodanil, benomyl, benzamacril, benzamacrylisobutyl, bialaphos, binapacryl, biphenyl, bitertanol, blasticidin-S, boscalid, bromuconazole, bupirimate, buthiobate, calcium polysulphide, capsimycin, captafol, captan, carbendazim, carvon, quinomethionate, chlobenthiazone, chlorfenazole, chloroneb, chloropicrin, chlorothalonil, chlozolinate, clozylacon, cufraneb, cymoxanil, cyproconazole, cyprodinil, cyprofuram, debacarb, dichlorophen, diclobutrazole, diclofluanid, diclomezine, dicloran, diethofencarb, dimethirimol, dimethomorph, dimoxystrobin, diniconazole, diniconazole-M, dinocap, diphenylamine, dipyrithione, ditalimfos, dithianon, dodemorph, dodine, drazoxolon, edifenphos, epoxiconazole, etaconazole, ethirimol, etridiazole, famoxadon, fenapanil, fenarimol, fenbuconazole, fenfuram, fenitropan, fenpiclonil, fenpropidin, fenpropimorph, fentin acetate, fentin hydroxide, ferbam, ferimzone, fluazinam, flumetover, fluoromide, fluquinconazole, flurprimidol, flusilazole, flusulfamide, flutolanil, flutriafol, folpet, fosetyl-aluminium, fosetyl-sodium, fthalide, fuberidazole, furalaxyl, furametpyr, furcarbonil, furconazole, furconazole-cis, furmecyclox, guazatine, hexachlorobenzene, hexaconazole, hymexazole, imazalil, imibenconazole, iminoctadine, iminoctadine albesilate, iminoctadine triacetate, iodocarb, iprobenfos (IBP), iprodione, irumamycin, isoprothiolane, isovaledione, kasugamycin, kresoxim-methyl, copper preparations, such as: copper hydroxide, copper naphthenate, copper oxychloride, copper sulphate, copper oxide, oxine-copper and Bordeaux mixture, mancopper, mancozeb, maneb, meferimzone, mepanipyrim, mepronil, metconazole, methasulfocarb, methfuroxam, metiram, metomeclam, metsulfovax, mildiomycin, myclobutanil, myclozolin, nickel dimethyldithiocarbamate, nitrothal-isopropyl, nuarimol, ofurace, oxadixyl, oxamocarb, oxolinic acid, oxycarboxim, oxyfenthiin, paclobutrazole, pefurazoate, penconazole, pencycuron, phosdiphen, pimaricin, piperalin, polyoxin, polyoxorim, probenazole, prochloraz, procymidone, propamocarb, propanosine-sodium, propiconazole, propineb, prothiocinazole, pyrazophos, pyrifenox, pyrimethanil, pyroquilon, pyroxyfur, quinconazole, quintozene (PCNB), sulphur and sulphur preparations, tebuconazole, tecloftalam, tecnazene, tetcyclasis, tetraconazole, thiabendazole, thicyofen, thifluzamide, thiophanate-methyl, tioxymid, tolclofos-methyl, tolylfluanid, triadimefon, triadimenol, triazbutil, triazoxide, trichlamide, tricyclazole, tridemorph, trifloxystrobin, triflumizole, triforine, uniconazole, validamycin A, vinclozolin, viniconazole, zarilamide, zineb, ziram and also Dagger G, OK-8705, OK-8801, a-(1,1-dimethylethyl)-(3-(2-phenoxyethyl)-1H-1,2,4-triazole-1-ethanol, a-(2,4-dichlorophenyl)-[3-fluoro-3-propyl-1H-1,2,4-triazole-1-ethanol, a-(2,4-dichlorophenyl)-[3-methoxy-a-methyl-1H-1,2,4-triazole-1-ethanol, a-(5-methyl-1,3-dioxan-5-yl)[3-[[4-(trifluoromethyl)-phenyl]-methylene]-1H-1,2,4-triazole-1-ethanol, (5RS, 6RS)-6-hydroxy-2,2,7,7-tetramethyl-5-(1H-1,2,4-triazol-1-yl)-3-octanone, (E)-a-(methoxyimino)-N-methyl-2-phenoxy-phenylacetamide, 1-isopropyl{2-methyl-1-[[[1-(4-methylphenyl)-ethyl]-amino]-carbonyl]-propyl}carbamate, 1-(2,4-dichlorophenyl)-2-(1H-1,2,4-triazol-1-yl)-ethanone-O-(phenyl methyl)-oxime, 1-(2-methyl-1-naphthalenyl)-1H-pyrrole-2,5-dione, 1-(3,5-dichlorophenyl)-3-(2-propenyl)-2,5-pyrrolidindione, 1-[(diiodomethyl)-sulphonyl]-4-methyl-benzene, 1-[[2-(2,4-dichlorophenyl)-1,3-dioxolan-2-yl]-methyl]-1H-imidazole, 1-[[2-(4-chlorophenyl)-3-phenyloxiranyl]-methyl]-1H-1,2,4-triazole, 1-1-[2-[(2,4-dichlorophenyl)-methoxy]-phenyl]-ethenyl]-1H-imidazole, 1-methyl-5-nonyl-2-(phenylmethyl)-3-pyrrolidinole, 2',6'-dibromo-2-methyl-4'-trifluoromethoxy-4'-trifluoro-methyl-1, 3-thiazole-carboxanilide, 2,2-dichloro-N-[1-(4-chlorophenyl)-ethyl]-1-ethyl-3-methyl-cyclopropanecarboxamide, 2,6-dichloro-5-(methylthio)-4-pyrimidinyl-thiocyanate, 2,6-dichloro-N-(4-trifluoromethylbenzyl)-benzamide, 2,6-dichloro-N-[[4-(trifluoromethyl)-phenyl]-methyl]-benzamide, 2-(2,3,3-triiodo-2-propenyl)-2H-tetrazole, 2-[(1-methylethyl)-sulphonyl]-5-(trichloromethyl)-1,3,4-thiadiazole, 2-[[6-deoxy-4-O-(4-0-methyl-(3-D-glycopyranosyl)-a-D-glucopyranos yl]-amino]-4-methoxy-1H-pyrrolo[2,3-d]pyrimidine-5-carbonitrile, 2-aminobutane, 2-bromo-2-(bromomethyl)-pentanedinitrile, 2-chloro-N-(2,3-dihydro-1,1,3-trimethyl-1H-inden-4-yl)-3-pyridinecarboxamide, 2-chloro-N-(2,6-dimethylphenyl)-N-(isothiocyanatomethyl)-acetamide, 2-phenylphenol (OPP), 3,4-dichloro-1-[4-(difluoromethoxy)-phenyl]-pyrrole-2,5-dione, 3,5-dichloro-N-[cyano[(1-methyl-2-propynyl)-oxy]-methyl]-benzamide, 3-(1,1-dimethyl-propyl-1-oxo-1H-indene-2-carbonitrile, 3-[2-(4-chlorophenyl)-5-ethoxy-3-isoxazolidinyl]-pyridine, 4-chloro-2-cyano-N,N-dimethyl-5-(4-methylphenyl)-1H-imidazole-1-sulphonamide, 4-methyl-tetrazolo[1,5-a]quinazolin-5(4H)-one, 8-(1,1-dimethylethyl)-N-ethyl-N-propyl-1,4-dioxaspiro[4, 5]decane-2-methanamine, 8-hydroxyquinoline sulphate, 9H-xanthene-2-[(phenylamino)-carbonyl]-9-carboxylic hydrazide, bis-(1-methylethyl)-3-methyl-4-[(3-methylbenzoyl)-oxy]-2,5-thiophenedicarboxylate, cis-1-(4-chlorophenyl)-2-(1H-1,2,4-triazol-1-yl)-cycloheptanol, cis-4-[3-[4-(1,1-dimethylpropyl)-phenyl-2-methylpropyl]-2,6-dimethyl-morpholine hydrochloride, ethyl [(4-chlorophenyl)-azo]-cyanoacetate, potassium bicarbonate, methanetetrathiol-sodium salt, methyl 1-(2,3-dihydro-2,2-dimethyl-inden-1-yl)-1H-imidazole-5-carboxylate, methyl N-(2,6-dimethylphenyl)-N-(5-isoxazolylcarbonyl)-DL-alaninate, methyl N-(chloroacetyl)-N-(2,6-dimethylphenyl)-DL-alaninate, N-(2,3-dichloro-4-hydroxyphenyl)-1-methyl-cyclohexanecarboxamide, N-(2,6-dimethyl phenyl)-2-methoxy-N-(tetra hydro-2-oxo-3-furanyl)-acetamide, N-(2,6-dimethyl phenyl)-2-methoxy-N-(tetrahydro-2-oxo-3-thienyl)-acetamide, N-(2-chloro-4-nitrophenyl)-4-methyl-3-nitro-benzenesulphonamide, N-(4-cyclohexylphenyl)-1,4,5,6-tetrahydro-2-pyrimidinamine, N-(4-hexylphenyl)-1,4,5,6-tetrahydro-2-pyrimidinamine, N-(5-chloro-2-methylphenyl)-2-methoxy-N-(2-oxo-3-oxazolidinyl)-acetamide, N-(6-methoxy)-3-pyridinyl)-cyclopropanecarboxamide, N-[2,2,2-trichloro-1-[(chloroacetyl)-amino]-ethyl]-benzamide, N-[3-chloro-4,5-bis(2-propinyloxy)-phenyl]-N'-methoxy-methanimidamide, N-formyl-N-hydroxy-DL-alanine-sodium salt, 0,0-diethyl [2-(dipropylamino)-2-oxoethyl]-ethylphosphoramidothioate, 0-methyl S-phenyl phenylpropylphosphoramidothioate, S-methyl 1,2,3-benzothiadiazole-7-carbothioate, and spiro[2H]-1-benzopyrane-2,1'(3'H)-isobenzofuran]-3'-one, N-trichloromethyl)thio-4-cyclohexane-1,2-dicarboximide, tetramethylthioperoxydicarbonic diamide, methyl N-(2,6-dimethylphenyl)-N-(methoxyacetyl)-DL-alaninate, 4-(2,2-difluoro-1,3-benzodioxol-4-yl)-1-H-pyrrol-3-carbonitril, or a combination of any thereof.

Embodiment 266 is a formulation, seed, or method of any one of embodiments 259-265, wherein the agrochemical comprises a bacterial inoculant of the genus *Bacillus*, and the bacterial inoculant of the genus *Bacillus* comprises *Bacillus argri, Bacillus aizawai, Bacillus albolactis, Bacillus amyloliquefaciens, Bacillus cereus, Bacillus coagulans, Bacillus endoparasiticus, Bacillus endorhythmos, Bacillus kurstaki, Bacillus lacticola, Bacillus lactimorbus, Bacillus lactis, Bacillus laterosporus, Bacillus lentimorbus, Bacillus licheniformis, Bacillus megaterium, Bacillus medusa, Bacillus metiens, Bacillus natto, Bacillus nigrificans, Bacillus popillae, Bacillus pumilus, Bacillus siamensis, Bacillus sphearicus, Bacillus* spp., *Bacillus subtilis, Bacillus thuringiensis, Bacillus unifagellatu*, or a combination of any thereof.

Embodiment 267 is a formulation, seed, or method of any one of embodiments 259-266, wherein the agrochemical comprises an herbicide, and the herbicide comprises 2,4-D, 2,4-DB, acetochlor, acifluorfen, alachlor, ametryn, atrazine, aminopyralid, benefin, bensulfuron, bensulide, bentazon, bromacil, bromoxynil, butylate, carfentrazone, chlorimuron, chlorsulfuron, clethodim, clomazone, clopyralid, cloransulam, cycloate, DCPA, desmedipham, dicamba, dichlobenil, diclofop, diclosulam, diflufenzopyr, dimethenamid, diquat, diuron, DSMA, endothall, EPTC, ethalfluralin, ethofumesate, fenoxaprop, fluazifop-P, flucarbazone, flufenacet, flumetsulam, flumiclorac, flumioxazin, fluometuron, fluroxypyr, fomesafen, foramsulfuron, glufosinate, glyphosate, halosulfuron, hexazinone, imazamethabenz, imazamox, imazapic, imazaquin, imazethapyr, isoxaben, isoxaflutole, lactofen, linuron, MCPA, MCPB, mesotrione, metolachlor-s, metribuzin, metsulfuron, molinate, MSMA, napropamide, naptalam, nicosulfuron, norflurazon, oryzalin, oxadiazon, oxyfluorfen, paraquat, pelargonic acid, pendimethalin, phenmedipham, picloram, primisulfuron, prodiamine, prometryn, pronamide, propanil, prosulfuron, pyrazon, pyrithiobac, quinclorac, quizalofop, rimsulfuron, sethoxydim, siduron, simazine, sulfentrazone, sulfometuron, sulfosulfuron, tebuthiuron, terbacil, thiazopyr, thifensulfuron, thiobencarb, tralkoxydim, triallate, triasulfuron, tribenuron, triclopyr, trifluralin, triflusulfuron, or a combination of any thereof.

Embodiment 268 is a formulation, seed, or method of any one of embodiments 259-267, wherein the agrochemical comprises a fertilizer and the fertilizer comprises ammonium sulfate, ammonium nitrate, ammonium sulfate nitrate, ammonium chloride, ammonium bisulfate, ammonium polysulfide, ammonium thiosulfate, aqueous ammonia, anhydrous ammonia, ammonium polyphosphate, aluminum sulfate, calcium nitrate, calcium ammonium nitrate, calcium sulfate, calcined magnesite, calcitic limestone, calcium oxide, calcium nitrate, dolomitic limestone, hydrated lime, calcium carbonate, diammonium phosphate, monoammonium phosphate, magnesium nitrate, magnesium sulfate, potassium nitrate, potassium chloride, potassium magnesium sulfate, potassium sulfate, sodium nitrates, magnesian limestone, magnesia, urea, urea-formaldehydes, urea ammonium nitrate, sulfur-coated urea, polymer-coated urea, isobutylidene diurea, $K_2SO_4\text{-}2MgSO_4$, kainite, sylvinite, kieserite, Epsom salts, elemental sulfur, marl, ground oyster shells, fish meal, oil cakes, fish manure, blood meal, rock phosphate, super phosphates, slag, bone meal, wood ash, manure, bat guano, peat moss, compost, green sand, cottonseed meal, feather meal, crab meal, fish emulsion, humic acid, or a combination of any thereof.

Embodiment 269 is a formulation, seed, or method of any one of embodiments 259-268, wherein the plant hormone comprises a gibberellin, an auxin, a kinetin, or a combination of any thereof.

Embodiment 270 is a seed of any one of embodiments 89-92, 114, 115, 118, 130-132, 143, 148, 182-192, and 194-269, wherein the seed comprises a seed from a plant of the family Brassicaceae.

Embodiment 271 is a method of any one of embodiments 107-172 and 182-269, wherein the plant comprises a plant of the family Brassicaceae.

Embodiment 272 is a seed of embodiment 270 or a method of embodiment 271, wherein the plant of the family Brassicaceae comprises a plant of the genus *Brassica*.

Embodiment 273 is a seed of embodiment 270 or a method of embodiment 271, wherein the plant of the family Brassicaceae comprises *Brassica napus, Brassica rapa, Brassica juncea, Brassica hirta, Brassica oleracea, Raphanus sativus, Sinapus alba*, or *Lepidium sativum*.

SEQUENCE LISTING (388 sequences)

SEQ ID NO: 1 - protein, 41 aa, Bacillus anthracis
MSNNNYSNGLNPDESLSASAFDPNLVGPTLPPIPPFTLPTG

SEQ ID NO: 2 - protein, 332 aa, Bacillus anthracis
MSNNNYSNGLNPDESLSASAFDPNLVGPTLPPIPPFTLPTGPTGPFTTGPTGPTGPTGPTGPTGPTGPTGPTGDTGTTGPTGPTGPTGPTGPTGPTGPTGPTGPTGFTPTGPTGPTGPTGDTGTTGPTGPTGPTGPTGPTGDTGTTGPTGPTGPTGPTGPTGPTGPTFTGPTGPTGPTGATGLTGPTGPTGPSGLGLPAGLYAFNSGGISLDLGINDPVPFNTVGSQFFTGTAISQLDADTFVISETGFYKITVIANTATASVLGGLTIQVNGVPVPGTGSSLISLGAPFTIVIQAITQITTTPSLVEVIVTGLGLSLALGTSASIIIEKVA

SEQ ID NO: 3 - protein, 33 aa, Bacillus anthracis
MSEKYIILHGTALEPNLIGPTLPPIPPFTFPNG

SEQ ID NO: 4 - protein, 209 aa, Bacillus anthracis
MSEKYIILHGTALEPNLIGPTLPPIPPFTFPNGPTGITGPTGATGFTGIGITGPTGVTGPTGIGITGPTGATGLGILPVFGTITTDVGIGFSVIVNTNINFTLPGPVSGTTLNPVDNSIIINTTGVYSVSFSIVFVIQAISSSILNLTINDSIQFAIESRIGGGPGVRATSARTDLLSLNQGDVLRVRIREATGDIIYSNASLVVSKVD

SEQ ID NO: 5 - protein, 44 aa, Bacillus anthracis
MVKVVEGNGGKSKIKSPLNSNFKILSDLVGPTFPPVPTGMTGIT

SEQ ID NO: 6 - protein, 647 aa, Bacillus anthracis
VVKVVEGNGGKSKIKSPLNSNFKILSDLVGPTFPPVPTGMTGITGSTGATGNTGPTGETGATGSAGITGSTGPTGNTGGTGSTGPTGNTGATGSTGVTGSTGVTGSTGVTGSTGVTGSTGPTGETGGTGSTGVTGSTGATGSTGVTGNTGPTGSTGATGNTGSIGETGGTGSMGPTGETGVTGSTGGTGSTGVTGNTGPTGSTGVTGSTGVTGSTGPTGSTGVTGSTGPTGSTGVTGSTGVTGNMGPTGSTGVTGNTGSTGTTGATGETGPMGSTGATGTTGPTGETGETGETGGTGSTGPTGNTGATGSTGVTGSTGVTGSTGVTGETGPTGSTGATGNTGPTGETGGTGSTGATGSTGVTGNTGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 7 - protein, 34 aa, Bacillus anthracis
MKQNDKLWLDKGIIGPENIGPTFPVLPPIHIPTG

SEQ ID NO: 8 - protein, 366 aa, Bacillus anthracis
MKQNDKLWLDKGIIGPENIGPTFPVLPPIHIPTGITGATGATGITGATGPTGTTGATGATGITGVTGATGITGVTGATGITGVTGATGITGVTGPTGITGATGPTGITGATGPAGITGVTGPTGITGATGPTGTTGVTGPTGDTGLAGATGPTGATGLAGATGPTGDTGATGPTGATGLAGATGPTGATGLTGATGATGATGGGAIIPFASGTTPALLVNAVLANTGTLLGFGFSQPGIAPGVGGTLTILPGVVGDYAFVAPRDGIITSLAGFFSATAALAPLTPVQIQMQIFIAPAASNTFTPVAPPLLLTPALPAIAIGTTATGIQAYNVPVVAGDKILVYVSLTGASPIAAVAGFVSAGLNIV

SEQ ID NO: 9 - protein, 30 aa, Bacillus anthracis
MDEFLSSAALNPGSVGPTLPPMQPFQFRTG

SEQ ID NO: 10 - protein, 77 aa, Bacillus anthracis
MDEFLSSAALNPGSVGPTLPPMQPFQFRTGPTGSTGAKGAIGNTEPYWHTGPPGIVLLTYDFKSLIISFAFRILPIS

SEQ ID NO: 11 - protein, 39 aa, Bacillus weihenstephensis
MFDKNEIQKINGILQANALNPNLIGPTLPPIPPFTLPTG

SEQ ID NO: 12 - protein, 299 aa, Bacillus weihenstephensis
MFDKNEIQKINGILQANALNPNLIGPTLPPIPPFTLPTGPTGVTGPTGVTGPTGVTGPTGVTGPTGVTGPTGVTGPTGVTGPTGVTGPTGVTGPTGVTGPTGVTGPTGVTGPTGVTGPTGVTGPTGETGPTGGTEGCLCDCCVLPMQSVLQQLIGETVILGTIADTPNTPPLFFLFTITSVNDFLVTVTDGTTTFVVNISDVTGVGFLPPGPPITLLPPTDVGCECECRERPIRQLLDAFIGSTVSLLASNGSIAADFSVEQTGLGIVLGTLPINPTTTVRFAISTCKITAVNITPITM

SEQ ID NO: 13 - protein, 39 aa, Bacillus weihenstephensis
MFDKNEMKKTNEVLQANALDPNIIGPTLPPIPPFTLPTG

SEQ ID NO: 14 - protein, 289 aa, Bacillus weihenstephensis
MFDKNEMKKTNEVLQANALDPNIIGPTLPPIPPFTLPTGPTGPTGPTGPTGPTGPTGPTGPTGPTGPTGPTGPTGPTGLTGPTGPTGLTGPTGLTGPTGPTGLTGQTGSTGPTGATEGCLCDCCVFPMQEVLRQLVGQTVILATIADAPNVAPRFFLFNITSVNDFLVTVTDPVSNTTFVVNISDVIGVGFSLTVPPLTLLPPADLGCECDCRERPIRELLDTLIGSTVNLLVSNGSIATGFNVEQTALGIVIGTLPIPINPPPPTLFRFAISTCKITAVDITPTPTAT

SEQ ID NO: 15 - protein, 49 aa, Bacillus cereus
MSRKDKFNRSRMSRKDRFNSPKIKSEISISPDLVGPTFPPIPSFTLPTG

SEQ ID NO: 16 - protein, 189 aa, Bacillus cereus
MSRKDKFNRSRMSRKDRFNSPKIKSEISISPDLVGPTFPPIPSFTLPTGITGPTFNINFRAEKNVAQSFTPPADIQVSYGNIIFNNGGGYSSVTNTFTAPINGIYLFSASIGFNPTLGTTSTLRITIRKNLVSVASQTGTITTGGTPQLEITTIIDLLASQTIDIQFSAAESGTLTVGSSNFFSGALLP

SEQ ID NO: 17 - protein, 33 aa, Bacillus cereus
MNEEYSILHGPALEPNLIGPTLPSIPPFTFPTG

SEQ ID NO: 18 - protein, 84 aa, Bacillus cereus
MNEEYSILHGPALEPNLIGPTLPSIPPFTFPTGPTGITGPTGATGFTGIGITGPTGVTGPTGIGITGPTGATGPTGIGITGPTG

SEQ ID NO: 19 - protein, 39 aa, Bacillus cereus
MKNRDNNRKQNSLSSNFRIPPELIGPTFPPVPTGFTGIG

SEQ ID NO: 20 - protein, 1056 aa, Bacillus cereus
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPGGVQGLQGPIGPTGATGAQGIQGIQGLQGPIGATGPEGSQGIQGVQGLPGATGPQGIQGAQGIQGTPGPSGNTGATGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGSQGIQGIPGPTGVTGEQGIQGVQGIQGATGATGDQGPQGIQGVIGPQGVTGATGDQGPQGIQGVPGPSGETGPQGVQGIQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGAIGPTGPMGPQGVQGVQGIQGATGAQGVQGPQGIQGIQGPTGATGDMGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGLTGSQGPTGIQGIQGEIGPTGPEGPEGLQGPQGIQGIQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGIQGVQGPTGATGETGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGSQGIQGPQGPQGIQGATGATGAQGPQGIQGPQGEIGPTGPQGPQGIQGPQGIQGPTG

SEQ ID NO: 21 - protein, 39 aa, Bacillus weihenstephensis
MSDKHQMKKISEVLQAHALDPNLIGPPLPPITPFTFPTG

SEQ ID NO: 22 - protein, 365 aa, Bacillus weihenstephensis
MSDKHQMKKISEVLQAHALDPNLIGPPLPPITPFTFPTGSTGPTGSTGSTGPTGSTGNTGPTGPTGPPVGTNLDTIYVTNDISNNVSAIDGNTNTVLTTIPVGTNPVGVGVNSSTNLIYVVNNGSDNISVINGSTNTVVATIPVGTQPFGVGVNPSTNLIYVANRTSNNVSVIKGGTNTVLTTIPVGTNPVGVGVNSSTNLIYVTNEIPNSVSVIKGGTNTVVATIPVGLFPFGVGVNSLTNLIYVVNNSPHNVSVIDGNTNTVLTTISVGTSPVGVGVNLSTNLIYVANEVPNNISVINGNTNTVLTTIPVGTTPFEVGVNSSTNLIYVSNLNSNNVSVINGSANTVIATVPVGSVPRGIGVKP

SEQ ID NO: 23 - protein, 30 aa, Bacillus weihenstephensis
MDEFLSFAALNPGSIGPTLPPVPPFQFPTG

SEQ ID NO: 24 - protein, 160 aa, Bacillus weihenstephensis
MDEFLSFAALNPGSIGPTLPPVPPFQFPTGPTGSTGSTGPTGSTGSTGPTGFNLPAGPASITLTSNETTACVSTQGNNTLFFSGQVLVNGSPTPGVVVSFSFSNPSLAFMVPLAVITNASGNFTAVFLAANGPGTVTVTASLLDSPGTMASVTITIVNCP

SEQ ID NO: 25 - protein, 30 aa, Bacillus weihenstephensis
MDEFLSSTALNPCSIGPTLPPMQPFQFPTG

SEQ ID NO: 26 - protein, 69 aa, Bacillus weihenstephensis
MDEFLSSTALNPCSIGPTLPPMQPFQFPTGPTGSTGTTGPTGSIGPTGNTGLTGNTGPTGITGPTGDTG

SEQ ID NO: 27 - protein, 36 aa, Bacillus weihenstephensis
MKERDRQNSLNSNFRISPNLIGPTFPPVPTGFTGIG

SEQ ID NO: 28 - protein, 934 aa, Bacillus weihenstephensis
MKERDRQNSLNSNFRISPNLIGPTFPPVPTGFTGIGITGPTGPQGPTGPQGPRGFQGPMGEMGPTGPQGVQGIQGPAGQMGATGPEGQQGPQGLRGPQGETGATGPQGVQGLQGPIGPTGATGAQGIQGIQGLQGPIGATGPEGPQGIQGVQGVPGATGSQGIQGAQGIQGPQGPSGNTGATGVTGQGISGPTGITGPTGITGPSGGPPGPTGATGATGPGGGPSGSTGATGATGNTGVTGSAGVTGNTGSTGSTGETGAQGLQGIQGVQGPIGPTGPEGPQGIQGIPGPTGVTGEQGIQGVQGIQGITGATGDQGPQGIQGAIGPQGITGATGDQGPQGIQGVPGPTGDTGSQGVQGIQGPMGDIGPTGPEGPEGLQGPQGIQGVPGPAGATGPEGPQGIQGIQGPIGVTGPEGPQGIQGIQGIQGITGATGAQGATGVQGVQGNIGATGPEGPQGVQGTQGDIGPTGPMGPQGVQGIQGIQGPTGAQGVQGPQGIQGIQGPTGVTGDTGTTGATGEGTTGATGVTGPSGVTGPSGGPAGPTGPTGPSGPTGLTGPSGGPPGPTGATGVTGGVGDTGATGSTGVTGATGVTGATGATGLQGPQGIQGVQGDIGPTGPQGVQGPQGIQGITGATGDQGPQGIQGPQGIQGPTGPQGIQGGQGPQGIQGATGATGAQGPQGIQGIQGVQGPTGPQGPTGIQGVQGEIGPTGPQGVQGLQGPQGPTGDTGPTGPQGPQGIQGPTGATGATGSQGIQGPTGATGATGSQGIQGPTGATGATGATGATGATGATGATGVTGVSTTATYSFANNTSGSAISVLLGGTNIPLPNNQNIGPGITVSGGNTVFTVTNAGNYYIAYTINITAALLVSSRITVNGSPLAGTINSPAVATGSFNATIISNLAAGSAISLQLFGLLAVATLSTTTPGATLTIIRLS

SEQ ID NO: 29 - protein, 39 aa, Bacillus mycoides
VFDKNEIQKINGILQANALNPNLIGPTLPPIPPFTLPTG

SEQ ID NO: 30 - protein, 287 aa, Bacillus mycoides
VFDKNEIQKINGILQANALNPNLIGPTLPPIPPFTLPTGPTGGTGPTGVTGPTGVTGPTGVTGPTGVTGPTGVTGPTGVTGPTGVTGPTGVTGPTGVTGPTGVTGPTGVTGPTGVTGPTGGTEGCLCDCCVLPMQSVLQQLIGETVILGTIADTPNTPPLFFLFTITSVNDFLVTVTDGTTTFVVNISDVTGVGFLPPGPPITLLPPTDVGCECECRERPIRQLLDAFIGSTVSLLASNGSIAADFSVEQTGLGIVLGTLPINPTTTVRFAISTCKITAVNITPITM

SEQ ID NO: 31 - protein, 30 aa, Bacillus mycoides
MDEFLYFAALNPGSIGPTLPPVQPFQFPTG

SEQ ID NO: 32 - protein, 190 aa, Bacillus mycoides
MDEFLYFAALNPGSIGPTLPPVQPFQFPTGPTGSTGATGSTGSTGSTGPTGSTGSTGSTGSTGPTGPTGPTGSTGPTGPTGFNLPAGPASITLTSNETTACVSTQGNNTLFFSGQVLVNGSPTPGVVVSFSFSNPSLAFMVPLAVITNASGNFTAVFLAANGPGTVTVTASLLDSPGTMASVTITIVNCP

SEQ ID NO: 33 - protein, 21 aa, Bacillus mycoides
MDSKNIGPTFPPLPSINFPTG

SEQ ID NO: 34 - protein, 335 aa, Bacillus mycoides
MDSKNIGPTFPPLPSINFPTGVTGETGATGETGATGATGETGATGETGETGATGATGATGATGETGATGATGATGAAGATGETGATGETGATGETGATGETGATGVTGETGATGETGAAGETGITGVTGPTGETGATGETGATGATGITGATGITGVAGATGETGAAGETGPTGATGAIGAIGATGATGITGVTGATGETGAAGATGITGVTGATGETGAAGATGITGATGITGVAGATGITGPTGIPGTIPTTNLLYFTFSDGEKLIYTNADGIAQYGTTQILSPSEVSYINLFINGILQPQPFYEVTAGQLTLLDDEPPSQGSSIILQFIIIN

SEQ ID NO: 35 - protein, 22 aa, Bacillus thuringiensis
MIGPENIGPTFPILPPIYIPTG

SEQ ID NO: 36 - protein, 234 aa, Bacillus thuringiensis
MIGPENIGPTFPILPPIYIPTGETGPTGITGATGETGPTGITGPTGITGATGETGSTGITGATGETGSTGITGPIGITGATGETGPIGITGATGETGPTGITGSTGITGLTGVTGLTGETGPIGITGPTGITGPTGVTGATGPTGGIGPITTTNLLYYTFADGEKLIYTDTDGIPQYGTTNILSPSEVSYINLFVNGILQPQPLYEVSTGKLTLLDTQPPSQGSSIILQFIIIN

SEQ ID NO: 37 - DNA, 299 bp, Bacillus cereus
tttcttaatcctttaccctttacttttgtaaaagttgatacacttccatccggctctgtaatttctaattcatcaataaatggtcttcgcaaaaagcctgtaattttatcataaacaattaaacgagtgagcctaaaagcagctaacgcgaaaataaaaaataaaagccagcttgtaaacagcataattccaccttcccttatcctctttcgcctatttaaaaaaaggtcttgagattgtgaccaaatctcctcaactccaatatcttattaatgtaaatacaaacaagaagataagga

SEQ ID NO: 38 - DNA, 58 bp, Bacillus cereus
accaaatctcctcaactccaatatcttattaatgtaaatacaaacaagaagataagga

SEQ ID NO: 39 - DNA, 300 bp, Bacillus anthracis
accacctaccgacgatccaatctgtacattcctagctgtaccaaatgcaagattaatatcgactaacacttgtcttactgttgatttaagttgcttctgtgcgattcaatgcttgcgtgatgttacgatttaaaactaaataatgagctaagcatggattgggtggcagaattatctgccacccaatccatgcttaacgagtattattatgtaaatttcttaaaattgggaacttgtctagaacatagaacctgtccttttcattaactgaaagtagaaacagataaaggagtgaaaaac

SEQ ID NO: 40 - DNA, 58 bp, Bacillus anthracis
acatagaacctgtccttttcattaactgaaagtagaaacagataaaggagtgaaaaac

SEQ ID NO: 41 - DNA, 300 bp, Bacillus anthracis
tagaagaagaacgccgactactttatgtcgcaattacacgggcgaaagaagaactttacatttcctctccgcaattttttagaggaaaaaaattagatatatctcgttttttatacactgtgcgaaaagatttacctgaaaagacatccactaaataaggatgtctttttttatattgtattatgtacatccctactatataaattccctgcttttatcgtaagaattaacgtaatatcaaccatatcccgttcatattgtagtagtgtatgtcagaactcacgagaaggagtgaacata

SEQ ID NO: 42 - DNA, 63 bp, Bacillus anthracis
tcaaccatatcccgttcatattgtagtagtgtatgtcagaactcacgagaaggagtgaacata

SEQ ID NO: 43 - protein, 35 aa, Bacillus cereus
MSNNNIPSPFFFNNFNPELIGPTFPPIPPLTLPTG

SEQ ID NO: 44 - protein, 222 aa, Bacillus cereus
MSNNNIPSPFFFNNFNPELIGPTFPPIPPLTLPTGPTGSTGATGATGPTGATGPTGATGPTGATGATGSTGATGPTGATGTFSSANASIVTPAPQTVNNLAPIQFTAPVLISKNVTFNGIDTFTIQIPGNYFFIGAVMTSNNQAGPVAVGVGFNGIPVPSLDGANYGTPTGQEVVCFGFSGQIPAGTTINLYNISDKTISIGGATAAGSSIVAARLSFFRIS

SEQ ID NO: 45 - protein, 41 aa, Bacillus cereus
MFSEKKRKDLIPDNFLSAPALDPNLIGPTFPPIPSFTLPTG

SEQ ID NO: 46 - protein, 293 aa, Bacillus cereus
MFSEKKRKDLIPDNFLSAPALDPNLIGPTFPPIPSFTLPTGSTGPTGPTGDTGPTGPTATICIRTDPDNGCSVAEGSGTVASGFASHAEACNTQAIGDCSHAEGQFATASGTASHAEGFQTTASGFASHTEGSGTTADANFSHTEGINTIVDVLHPGSHIMGKNGTTRSSFSWHLANGLAVGPSLNSAVIEGVTGNLYLDGVVISPNAADYAEMFETIDGNLIDVGYFVTLYGEKIRKANANDDYILGVVSATPAMIADASDLRWHNLFVRDEWGRTQYHEVVVPEKKMAMEE

SEQ ID NO: 47 - protein, 49 aa, Bacillus cereus
MTRKDKFNRSRISRRDRFNSPKIKSEILISPDLVGPTFPPIPSFTLPTG

SEQ ID NO: 48 - protein, 83 aa, Bacillus cereus
MTRKDKFNRSRISRRDRFNSPKIKSEILISPDLVGPTFPPIPSFTLPTGVTGPTGNTGPTGITGPTGDTGPTGDTGPTGITGP

SEQ ID NO: 49 - protein, 38 aa, Bacillus cereus
MSRKDRFNSPKIKSEISISPDLVGPTFPPIPSFTLPTG

SEQ ID NO: 50 - protein, 163 aa, Bacillus cereus
MSRKDRFNSPKIKSEISISPDLVGPTFPPIPSFTLPTGITGPTGNTGPTGDTGPTGPTFNINFRAEKNGAQSFTPPADIQVSYGNIIFNNGGGYSSVTNTFTAPINGIYLFSANIGFNPTLGTTSTLRITIRKNLVSVASQTIDIQFSAAESGTLTVGSSNFF

SEQ ID NO: 51 - protein, 39 aa, Bacillus cereus
MKERDNKGKQHSLNSNFRIPPELIGPTFPPVPTGFTGIG

SEQ ID NO: 52 - protein, 323 aa, Bacillus cereus
MKERDNKGKQHSLNSNFRIPPELIGPTFPPVPTGFTGIGITGPTGPQGPTGPQGPRGFQGPMGEMGPTGPQGVQGIQGPAGQMGATGPEGQQGPEGLRGPVGATGATGLQGVQGIQGPIGSTGATGAQGIQGIQGLQGPIGATGPEGPQGIQGVQGLPGATGPQGVQGVQGVIGPQGPSGSTGGTGATGQGVTGPTGITGSTGVTGPSGGPPGPTGPTGATGPGGGPSGSTGVTGSTGNTGATGSPGVTGATGPTGSTGATGIQGSQGIQGIQGIQGPLGPTGPEGPQGIQGIPGPTGITGEQGIQGVQGIQGITGATGDQGT

SEQ ID NO: 53 - protein, 39 aa, Bacillus cereus
MRERDNKRQQHSLNPNFRISPELIGPTFPPVPTGFTGIG

SEQ ID NO: 54 - protein, 436 aa, Bacillus cereus
MRERDNKRQQHSLNPNFRISPELIGPTFPPVPTGFTGIGITGPTGPQGPTGPQGPRGFQGPMGEMGPTGPQGVQGIQGPVGPIGATGPEGQQGPQGLRGPQGETGATGPGGVQGLQGPIGPTGATGAQGVQGIQGLQGPIGATGPEGPQGIQGVQGLPGATGSQGIQGVQGIQGPQGPSGNTGATGATGQGITGPTGITGPTGITGPSGGPPGPTGPTGATGPGGGPSGSTGATGATGNTGATGNTGITGATGSTGPTGSTGAQGLQGIQGIQGPIGPTGPEGPQGIQGIPGPTGVTGEQGIQGVQGIQGITGATGDQGPQGIQGVIGAQGVTGATGDQGPQGIQGVPGPSGATGPQGVQGIQGPMGDIGPTGPEGPEGLQGPQGIQGVPGPVGATGPEGPQGIQGIQGVQGATGPQGPQGIQGIQGVQGITGATG

SEQ ID NO: 55 - protein, 36 aa, Bacillus thuringiensis
MKNRDNKGKQQSNFRIPPELIGPTFPPVPTGFTGIG

SEQ ID NO: 56 - protein, 470 aa, Bacillus thuringiensis
MKNRDNKGKQQSNFRIPPELIGPTFPPVPTGFTGIGITGPTGPQGPTGPQGPRGFQGPMGEMGPTGPQGVQGIQGPVGPIGATGPEGQQGAQGLRGPQGETGATGPQGVQGLQGPIGPTGATGAQGIQGIQGLQGPIGATGPEGPQGIQGVQGLPGATGPQGIQGAQGIQGTQGPSGNTGATGATGQGLTGPTGITGPTGITGPSGGPPGPTGPTGATGPGGGPSGSTGATGATGDTGATGSTGVTGATGAQGPQGVQGIQGPTGATGATGATGPQGIQGPQGIQGPTGATGATGSQGPTGNTGPTGSQGIQGPTGPTGAGATGATGATGATGVSTTATYAFANNTSGSIISVLLGGTNIPLPNNQNIGPGITVSGGNTVFTVANAGNYYIAYTINLTAGLLVSSRITVNGSPLAGTINSPAVAAGSFSATIIANLPAGAAVSLQLFGVIALATLSTATPGATLTIIRLS

SEQ ID NO: 57 - protein, 136 aa, Bacillus mycoides
MKFSKKSTVDSSIVGKRVVSKVNILRFYDARSCQDKDVDGFVDVGELFTIFRKLNMEGSVQFKAHNSIGKTYYITINEVYVFVTVLLQYSTLIGGSYVFDKNEIQKINGILQANALNPNLIGPTLPPIPPFTLPTG

SEQ ID NO: 58 - protein, 384 aa, Bacillus mycoides
MKFSKKSTVDSSIVGKRVVSKVNILRFYDARSCQDKDVDGFVDVGELFTIFRKLNMEGSVQFKAHNSIGKTYYITINEVYVFVTVLLQYSTLIGGSYVFDKNEIQKINGILQANALNPNLIGPTLPPIPPFTLPTGPTGGTGPTGVTGPTGVTGPTGVTGPTGVTGPTGVTGPTGVTGPTGVTGPTGVTGPTGVTGPTGVTGPTGVTGPTGVTGPTGGTEGCLCDCCVLPMQSVLQQLIGETVILGTIADTPNTPPLFFLFTITSVNDFLVTVTDGTTTFVVNISDVTGVGFLPPGPPITLLPPTDVGCECECRERPIRQLLDAFIGSTVSLLASNGSIAADFSVEQTGLGIVLGTLPINPTTTVRFAISTCKITAVNITPITM

SEQ ID NO: 59 - protein, 36 aa, Bacillus cereus
MKERDKQNSLNSNFRISPNLIGPTFPPVPTGFTGIG

SEQ ID NO: 60 - protein, 1321 aa, Bacillus cereus
MKERDKQNSLNSNFRISPNLIGPTFPPVPTGFTGIGITGPTGPQGPTGPQGPRGLQGPMGEMGPTGPQGVQGIQGPVGSIGATGPEGQQGPQGLRGPQGETGATGPQGVQGLQGPAGPTGATGAQGIQGIQGLQGPIGATGPEGPQGIQGVQGLPGATGPQGIQGAQGMQGLQGPSGNTGATGATGQGITGPTGVTGPTGITGPSGGPPGPTGPTGATGPGGGPSGSTGATGATGNTGATGSTGVTGSTGVTGATGSTGPTGSTGAQGLQGIQGIQGPIGPTGPEGPQGIQGIPGPTGVTGEQGIQGVQGIQGATGATGDQGPQGIQGAIGPQGATGATGDQGPQGIQGVPGPSGATGPQGVQGLQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGGIGPTGPMGPQGVQGVQGIQGATGAQGVQGPQGIQGIQGIQGIQGPTGATGDTGATGATGEGTTGPTGVTGPTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGVQGPQGDIGPTGPQGIQGPQGSQGIQGATGGTGAQGPQGIQGPQGDVGPTGPQGPTGIQGIQGEIGPTGPEGPEGLQGPQGIQGVQGPVGATGPEGPQGIQGIQGVQGATGSQGPQGIQGIQGVQGITGATGAQGATGIQGIQGEIGATGPEGPQGVQGVQGEIGPTGPMGPQGVQGVQGIQGATGAQGVQGPQGIQGIQGPTGATGETGATGATGEGTTGPTGVTGPTGVTGPSGGPAGPTGPTGPSGPAGVTGPSGGPPGPTGATGATGATGVTGDTGATGSTGVTGATGETGATGVTGLQGPQGIQGVQGEIGPTGPQGIQGPQGIQGVTGATGAQGPQGIQGPQGDIGPTGPQGIQGPQGPQGIQGATGATGAQGPQGIQGPQGEIGPTGPQGPQGIQGPQGIQGPTGATGATGATGLQGIQGPQGIQGPQGIQGPTGATGATGATGLQGIQGPQGIQGPQGIQGPTGATGATGATGLQGIQGPQGIQGPQGIQGPTGATGATGATGSQGPTGDTGPTGAGATGATGATGVSTTATYAFANNTSGTAISVLLGGTNIPLPNNQNIGPGITVSGGNTVFTVASAGNYYIAYTINLTAGLLVSSRITVNGSPLAGTINAPTVATGSFSATIIANLPAGAAISLQLFGLVAIATLSTTTPGATLTIIRLS

SEQ ID NO: 61 - protein, 39 aa, Bacillus cereus
MMENKKGSKHNEFLSAKAFNPNLVGPTLPPVPSFTLPTG

SEQ ID NO: 62 - protein, 309 aa, Bacillus cereus
MMENKKGSKHNEFLSAKAFNPNLVGPTLPPVPSFTLPTGPTGATGATGVTGATGATGATGATGVTGATGATGVTGATGATGVTGATGATGATGATGVTGATGATGVTGATGATGVTGATGATGVTGVTGATGATGATGVTGPTGATGATGATGVTGPTGATGATGATGGLAVASASAMTSTAQTVDNLVAVQFTAPVLELDSVIFNGTDTFTVLVPGNYYCIGSLMPAETQTGPFAVGIGLNGIPVPALDGANYAQSAGQEVVGFGLTGQIPAGTTISLFNLSGHTISIGGTISGATSVAARLLLFRIS

SEQ ID NO: 63 - protein, 41 aa, Bacillus weihenstephanensis
MSNNNYSDGLNPDEFLSASAFDPNLVGPTLPPIPPFTLPTG

SEQ ID NO: 64 - protein, 292 aa, Bacillus weihenstephanensis
MSNNNYSDGLNPDEFLSASAFDPNLVGPTLPPIPPFTLPTGPTGPTGPTGPTGPTVPTGPTGPTGPTGPTGPTGDTGTTGATGDTGATGDTGATGPTGPTGDTGATGPTGPTGDTGATGPTGPTGDTGATGPTGPTGDTGATGATGPTGPTGPTGPSGLGLPAGLYAFNSATISLALGINDPVPFNTVGSQFGTAISQLDADTFIISETGFYKITVIAYTAAVSILGSLAIQVNGVNIPGAGTSLISLGAPLVIQAITQITITPSMVEAVVTGLGLSLALGTSASIIIEKIA

SEQ ID NO: 65 - protein, 30 aa, Bacillus thuringiensis
MDEFLSSAAINPNLVGPTLPPVPPFTLPTG

SEQ ID NO: 66 - protein, 233 aa, Bacillus thuringiensis
MDEFLSSAAINPNLVGPTLPPVPPFTLPTGPTGSTGPTGTTGPTGPTGTTGTTGTTGPTGPTGTTGPTGPTGTTGTTGPTGTTGTLSVAYGHFWQTDIITVPFESPFSFDQAGPMVGGISLLNPTTISITQPGDYRVSFISSINLTVALVFPYSPTISILLNNSLIPNFKATFGLLIQDLEDVDCDQLTGETILSIPANSTLQLINNSFVGNRDIRTCDNGINALELTIIKLN

SEQ ID NO: 67 - protein, 33 aa, Bacillus cereus
MFDKNKILQANAFNSNLIGPTLPPIPPFTLPTG

SEQ ID NO: 68 - protein, 295 aa, Bacillus cereus
MFDKNKILQANAFNSNLIGPTLPPIPPFTLPTGPTGGTGPTGVTGPTGVTGPIGVTGPTGVTGPTGVTGPTGITGPTGVTGPTGVTGPTGVTGPTGVTGPTGVTGPTGVTGPTGVTGPTGVTGPTGVTGPTGSTESCLCDCCVLPMQNVLQQLIGETVLLGTIADAPNTPPLFFLFTITSVNDFLVTVTDGSTSYVVNISDVTGVGFLPPGPSITLLPPVDIGCECDCRERPIRELLDTLIGSTVNLLASTGSIAADFNVEQTGLGIVLGTLPINPTTIVRFAISTCKITAVNIL

SEQ ID NO: 69 - protein, 44 aa, Bacillus cereus
MSDENEKKYSNELAQADFISAAAFDPSLVGPTLPPTPPFTLPTG

SEQ ID NO: 70 - protein, 639 aa, Bacillus cereus
MSDENEKKYSNELAQADFISAAAFDPSLVGPTLPPTPPFTLPTGPTGATGPTGATGPTGATGSTGVTGPTGVTGPTGATGPTGATGSTGVTGPTGATGPSGATGSTGTTGPTGDTGPTGITGPTGVTGPTGATGPTGATGPTGATGSTGVTGPTGVTGPTGATGPTGATGSTGVTGPTGITGPTGATGTTGSTGPTGVTGPTGATGPTGATGPTGATGSTGVTGPTGITGPTGATGTTGSTGPTGVTGPTGATGPTGATGPTGATGSTGVTGPTGVTGPTGATGPTGATGSTGVTGPTGATGPTGATGSTGVTGPTGVTGPTGATGSTGATGPTGATGSTGVTGPTGATGPTGATGPTGATGSTGVTGPTGITGPTGATGTTGSTGPTGVTGPTGVTGPTGVTGPTGATGPTGATGSTGVTGPTGITGPTGATGTTGSTGPTGVTGPTGVTGPTGATGPTGVTGPTGATGPTGATGATATTSTKAILFGGTNAGFQRIAGSPGADSQTLPYVTAGAGSVVAFSASINVNNLGTGVYLLRVCDNVPTNLASPGAGQIVSTITLTLTANITGTIVFSIKPTDIGAQPVKVFNPNPVVAPATVTWTSTIPGNPVARTDAISLFITPGITQSAVYSVFISTAV

SEQ ID NO: 71 - protein, 38 aa, Bacillus cereus; identical to SEQ ID NO: 49

SEQ ID NO: 72 - protein, 163 aa, Bacillus cereus
MSRKDRFNSPKIKSEISISPDLVGPTFPPIPSFTLPTGITGPTGNTGATGDTGPTGPTFNINFRAEKNGAQSFTPPADIQVSYGNIIFNNGGGYSSVTNTFTAPINGIYLFSANIGFNPTLGTTSTLRITIRKNLVSVASQTIDIQFSAAESGTLTVGSSNFF

SEQ ID NO: 73 - protein, 30 aa, Bacillus cereus
MDEFLSSAALNPGSVGPTLPPMQPFQFSTG

SEQ ID NO: 74 - protein, 77 aa, Bacillus cereus
MDEFLSSAALNPGSVGPTLPPMQPFQFSTGPTGSTGATGATGNTEPYWHTGPPGIVLLTYDFKSLIISFAFQILPIS

SEQ ID NO: 75 - protein, 48 aa, Bacillus weihenstephanensis
MFLGGGYMERKNKWYGLNSNVNLSASSFDPNLVGPTLPPISPISVPTG

SEQ ID NO: 76 - protein, 247 aa, Bacillus weihenstephanensis
MFLGGGYMERKNKWYGLNSNVNLSASSFDPNLVGPTLPPISPISVPTGPTGETGITGPTGPTGPTGPTGVTGITGPTGPTGATGITGPTGPTGETGITGPTGPGPTVSLKFLYVANFNENTVEIYDIFNPIFPVRIGEFNGGNLANPAGLAITGTTLYVTNNGDNTVEIYDILNPIAPVHVGEFNGGNLSEPDGLAITGTTLYVANFNDNTVEIYDILNPIAPVRVGEFNAGNLSSPAGLIIFSLFG

SEQ ID NO: 77 - protein, 30 aa, Bacillus cereus
MDELLSSTLINPDLLGPTLPAIPPFTLPTG

SEQ ID NO: 78 - protein, 536 aa, Bacillus cereus
MDELLSSTLINPDLLGPTLPAIPPFTLPTGPTGSTGPTGPTGSTGPTGPTGSTGPTGPTGSTGLTGLTGPTGPTGPTGPTGPTGPTGSTGLTGPTGPNSDTGPTGPTGPTGPSDGPTGPTGATGPTGPPDGPTGDTGPTGSTGPTGDTGPTGSTGPTGDTGPTGSTGPTGDTGPTGSTGPTGDTGPTGSTGPTGDTGPTGSTGPTGPGCIEPLPTFTQIVYVNKAGNDATADGSECAPFLTVTAAMASITDAIAPFPDPLNITKRYAISIGPGNYIEPLIHLKANVQLVGTSTLLTRLQIPFDINDPSWFDLNFSQDPRSGFVNLTLLSGPLDFNFQTAQSVSGKLFFVSVNITPTPIFTALSTSVNQVNIRDSMLSGGYTQNGINMAMFASFVSSGNITINSQATTDTQVNLVGGGINGNVIINVLPGHIPIDPLNLTSFAITENIFNPSPNSGNLFVNGANNVITRVRATVDSLPIRSRINLIGTSTSLIRVDDAFDLAYTPINPANWAPLPPTTVQEALDRIAALMAITIGTP

SEQ ID NO: 79 - protein, 39 aa, Bacillus cereus; identical to SEQ ID NO: 19

SEQ ID NO: 80 - protein, 1309 aa, Bacillus cereus
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPGGVQGLQGPIGPTGATGAQGIQGIQGLQGPIGATGPEGSQGIQGVQGLPGATGPQGIQGAQGIQGTPGPSGNTGATGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGSQGIQGIPGPTGVTGEQGIQGVQGIQGATGATGDQGPQGIQGVIGPQGVTGATGDQGPQGIQGVPGPSGETGPQGVQGIQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGAIGPTGPMGPQGVQGVQGIQGATGAQGVQGPQGIQGIQGPTGATGDMGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGSQGPTGIQGIQGEIGPTGPRRPEGCRGRKRIQGVQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGIQGVQGPTGATGDTGATGATGEGTTGPTGVTGPTGVTGPSGGPAGPTGPTGPSGPAGVTGPSGGPPGPTGATGATGVTGDTGATGSTGVTGATGATGVTGLQGPQGIQGVQGEIGPTGPQGIQGPQGIQGVTGATGAQGPQGIQGPQGDIGPTGSQGIQGPQGPQGIQGATGATGAQGPQGIQGPQGEIGPTGPQGPQGIQGPQGIQGPTGATGATGATGPQGIQGPQGIQGPQGIQGPTGVTGATGATGPQGIQGPQGIQGPQGIQGPTGATGATGATGPQGIQGPQGIQGPQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAVATLSTATPGATLTIIRLS

SEQ ID NO: 81 - protein, 44 aa, Bacillus cereus
MVKVVEGNSGKSKIKSSLNSNFKLSSGLVGPTFPPVPTGMTGIT

SEQ ID NO: 82 - protein, 815 aa, Bacillus cereus
MVKVVEGNSGKSKIKSSLNSNFKLSSGLVGPTFPPVPTGMTGITGSTGATGNTGPTGETGATGSTGVTGNTGPTGETGVTGSTGPTGETGSTGNTGATGETGPTGSTGATGSTGVTGSTGPTGNTGPTGETGVTGSTGPTGNTGATGETGPTGSTGPTGETGVTGSTGVTGPTGATGNTGATGSTGVTGNTGPTGETGVTGSTGPTGNTGATGNTGPTGETGSTGVTGSTGATGSTGVTGPTGVTGPTGETGVTGSTGPTGNTGATGNTGPTGETGVTGSTGPTGNTGATGNTGATGETGSTGVTGSTGVTGSTGATGSTGVTGNTGATGSTGATGNTGPTGATGSTGVTGNTGPTGETGPTGSTGPTGNTGATGNTGATGATGATGATGSTGPTGNTGATGNTGPTGVTGSTGPTGSTGETGETGPTGETGVTGSTGPTGPTGATGNTGPTGETGATGSTGETGETGPTGETGVTGSTGPTGNTGATGNTGPTGETGVTGSTGPTGNTGATGNTGPTGETGETGVTGSTGVTGNTGATGSTGATGNTGPTGETGATGPTGATGVTGSTGPTGNTGPTGETGSTGSTGATGSTGVTGNTGATGETGPTGSTGATGNTGATGETGPTGATGVTGPTGSTGVTGSTGPTGSTGATGATGSTGPTGSTGTTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFNATIIASLPAGAAVSLQLFGVVALATLSTATPGATLTIIRLS

SEQ ID NO: 83 - protein, 40 aa, Bacillus anthracis
MEGNGGKSKIKSPLNSNFKILSDLVGPTFPPVPTGMTGIT

SEQ ID NO: 84 - protein, 469 aa, Bacillus anthracis
MEGNGGKSKIKSPLNSNFKILSDLVGPTFPPVPTGMTGITGSTGATGNTGPTGETGATGSAGITGSTGPTGNTGGTGSTGSTGNTGATGSTGVTGSTGVTGSTGVTGSTGVTGSTGPTGETGGTGSTGVTGSTGATGSTGVTGSTGVTGETGPTGSTGATGNTGPTGETGGTGSTGATGSTGVTGNTGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 85 - protein, 34 aa, Bacillus thuringiensis; identical to SEQ ID NO: 7

SEQ ID NO: 86 - protein, 285 aa, Bacillus thuringiensis
MKQNDKLWLDKGIIGPENIGPTFPVLPPIHIPTGITGATGATGITGATGPTGTTGATGATGITGVTGATGITGVTGATGITGATGPTGITGATGPAGITGATGPAGITGATGPAGITGATGPTGITGATGPTGITGATGPTGITGATGPAGITGATGPTGTTGVTGATGITGVTGATGITGATGPTGTTGVTGPTGVIGPITTTNLLFYTFADGEKLIYTDSDGLAQYGTTHILSPDEVSYINLFINGILQPQPLYQVSTGQLTLLDNQPPSQGSSIILQFIIIN

SEQ ID NO: 87 - protein, 34 aa, Bacillus cereus
MNSNEKLSLNKGMVRPENIGPTFPVLPPIYIPTG

SEQ ID NO: 88 - protein, 258 aa, Bacillus cereus
MNSNEKLSLNKGMVRPENIGPTFPVLPPIYIPTGATGATGATGATGATGATGATGATGATGATGATGATGATGATGVTGATGATGATGVTGATGATGVTGATGVTGATGATGVTGATGVTGATGATGATGVTGATGATGATGATGVTGATGVTGVTGVTGATGATGPTGVIGPITTTNLLFYTFSDGEKLIYTDSDGLAQYGTTHILSPDEVSYINLFINGILQPQPLYQVSTGQLTLLDNQPPSQGSSIILQFIIIN

SEQ ID NO: 89 - protein, 34 aa, Bacillus cereus
MKRNDNLSLNKGMIGPENIGPTFPILPPIYIPTG

SEQ ID NO: 90 - protein, 279 aa, Bacillus cereus
MKRNDNLSLNKGMIGPENIGPTFPILPPIYIPTGATGPTGITGPTGETGPTGITGPTGVTGPTGITGPTGATGPTGITGPTGATGPTGITGPTGATGPTGETGPTGITGPTGATGPTGITGPTGATGPTGETGPTGETGPTGVTGPTGITGPTGATGPTGITGPTGATGPTGETGPTGITGPTGATGPTGGIGPITTTNLLYYTFADGEKLIYTDADGIPQYGTTNILSPSEVSYINLFVNGILQPQPLYEVSTGKLTLLDTQPPSQGSSIILQFIIIN

SEQ ID NO: 91 - protein, 99 aa, Bacillus cereus
MDSFVDVGEIFTIFRKLNMEGSLQFKVHNSMGKTYYITINEVYVYVTVLLQYSTLIGGSYVFDKNEIQKINGILQANALNPNLIGPTLPPIPPFTLPTG

SEQ ID NO: 92 - protein, 145 aa, Bacillus cereus
MDSFVDVGEIFTIFRKLNMEGSLQFKVHNSMGKTYYITINEVYVYVTVLLQYSTLIGGSYVFDKNEIQKINGILQANALNPNLIGPTLPPIPPFTLPTGPTGVTGPTGGTGPTGVTGPTGVTGPTGVTGVTGPTGVTGPTGVTGP

SEQ ID NO: 93 - protein, 136 aa, Bacillus weihenstephanensis
MKFSKKSTVDSSIVGKRVVSKVNILRFYDARSWQDKDVDGFVDVGELFTIFRKLNMEGSVQFKAHNSIGKTYYITINEVYVFVTVLLQYSTLIGGSYVFDKNEIQKINGILQANALNPNLIGPTLPPIPPFTLPTG

SEQ ID NO: 94 - protein, 142 aa, Bacillus weihenstephanensis
MKFSKKSTVDSSIVGKRVVSKVNILRFYDARSWQDKDVDGFVDVGELFTIFRKLNMEGSVQFKAHNSIGKTYYITINEVYVFVTVLLQYSTLIGGSYVFDKNEIQKINGILQANALNPNLIGPTLPPIPPFTLPTGPTGGTG

SEQ ID NO: 95 - protein, 196 aa, Bacillus anthracis
MSNNNYSNGLNPDESLSASAFDPNLVGPTLPPIPPFTLPTGPTGPFTTGPTGPTGPTGPTGPTGPTGPTGPTGDTGTTGPTGPTGPTGPTGPTGPTGPTGPTGPTGFTPTGPTGPTGPTGDTGTTGPTGPTGPTGPTGPTGDTGTTGPTGPTGPTGPTGPTGPTGPTFTGPTGPTGPTGATGLTGPTGPTGPSGLG

SEQ ID NO: 96 - protein, 17 aa, Bacillus anthracis
MAFDPNLVGPTLPPIPP

SEQ ID NO: 97 - protein, 17 aa, Bacillus anthracis
MALEPNLIGPTLPPIPP

SEQ ID NO: 98 - protein, 17 aa, Bacillus weihenstephanensis
MALNPNLIGPTLPPIPP

SEQ ID NO: 99 - protein, 17 aa, Bacillus weihenstephanensis
MALDPNIIGPTLPPIPP

SEQ ID NO: 100 - protein, 17 aa, Bacillus cereus
MALEPNLIGPTLPSIPP

SEQ ID NO: 101 - protein, 17 aa, Bacillus weihenstephanensis
MALDPNLIGPPLPPITP

SEQ ID NO: 102 - protein, 17 aa, Bacillus weihenstephanensis
MALNPGSIGPTLPPVPP

SEQ ID NO: 103 - protein, 17 aa, Bacillus weihenstephanensis
MALNPCSIGPTLPPMQP

SEQ ID NO: 104 - protein, 17 aa, Bacillus mycoides
MALNPGSIGPTLPPVQP

SEQ ID NO: 105 - protein, 17 aa, Bacillus anthracis
MALNPGSVGPTLPPMQP

SEQ ID NO: 106 - protein, 17 aa, Bacillus cereus
MALDPNLIGPTFPPIPS

SEQ ID NO: 107 - protein, 18 aa, Bacillus thuringiensis
MAAINPNLVGPTLPPVPP

SEQ ID NO: 108 - protein, 799 aa, Bacillus mycoides
MKRKTPFKVFSSLAITTMLGCTFALGTSVAYAETTSQSKGSISTTPIDNNLIQEERLAEALKERGTIDQSASKEETQKAVEQYIEKKKGDQPNKEILPDDPAKEASDFVKKVKEKKMEEKEKVKKSVENASSEQTPSQNKKQLNGKVPTSPAKQAPYNGAVRTDKVLVLLVEFSDYKHNNIEQSPGYMYANDFSREHYQKMLFGNEPFTLFDGSKVKTFKQYYEEQSGGSYTTDGYVTEWLTVPGKAADYGADGKTGHDNKGPKGARDLVKEALKAAAEKGLDLSQFDQFDRYDTNGDGNQNEPDGVIDHLMVIHAGVGQEAGGGKLGDDAIWSHRSKLAQDPVAIEGTKSKVSYWDGKVAAHDYTIEPEDGAVGVFAHEFGHDLGLPDEYDTNYTGAGSPVEAWSLMSGGSWTGRIAGTEPTSFSPQNKDFLQKNMDGNWAKIVEVDYDKIKRGVGFPTYIDQSVTKSNRPGLVRVNLPEKSVETIKTGFGKHAYYSTRGDDMHTTLETPLFDLTKAANAKFDYKANYELEAECDFIEVHAVTEDGTKTLIDKLGDKVVKGDQDTTEGKWIDKSYDLSQFKGKKVKLQFDYITDPALTYKGFAMDNVNVTVDGKVVFSDDAEGQAKMKLNGFVVSDGTEKKPHYYYLEWRNYAGSDEGLKVGRGPVYNTGLVVWYADDSFKDNWVGRHPGEGFLGVVDSHPEAVVGNLNGKPVYGNTGLQIADAAFSLDQTPAWNVNSFTRGQFNYPGLPGVATFDDSKVYSNTQIPDAGRKVPQLGLKFQVVGQADDKSAGAIWIRR

SEQ ID NO: 109 - protein, 152 aa, Bacillus anthracis
MSCNENKHHGSSHCVVDVVKFINELQDCSTTTCGSGCEIPFLGAHNTASVANTRPFILYTKAGAPFEAFAPSANLTSCRSPIFRVESVDDDSCAVLRVLSVVLGDSSPVPPTDDPICTFLAVPNARLVSTSTCITVDLSCFCAIQCLRDVTI

SEQ ID NO: 110 - protein, 167 aa, Bacillus anthracis
MFSSDCEFTKIDCEAKPASTLPAFGFAFNASAPQFASLFTPLLLPSVSPNPNITVPVINDTVSVGDGIRILRAGIYQISYTLTISLDNSPVAPEAGRFFLSLGTPANIIPGSGTAVRSNVIGTGEVDVSSGVILINLNPGDLIRIVPVELIGTVDIRAAALTVAQIS

SEQ ID NO: 111 - protein, 156 aa, Bacillus anthracis
MSCNCNEDHHHHDCDFNCVSNVVRFIHELQECATTTCGSGCEVPFLGAHNSASVANTRPFILYTKAGAPFEAFAPSANLTSCRSPIFRVESIDDDDCAVLRVLSVVLGDTSPVPPTDDPICTFLAVPNARLISTNTCLTVDLSCFCAIQCLRDVTI

SEQ ID NO: 112 - protein, 182 aa, Bacillus anthracis
MEVGGTSVKNKNKSSTVGKPLLYIAQVSLELAAPKTKRIILTNFENEDRKEESNRNENVVSSAVEEVIEQEEQQQEQEQEQEEQVEEKTEEEEQVQEQQEPVRTVPYNKSFKDMNNEEKIHFLLNRPHYIPKVRCRIKTATISYVGSIISYRNGIVAIMPPNSMRDIRLSIEEIKSIDMAGF

SEQ ID NO: 113 - protein, 174 aa, Bacillus anthracis
MKERSENMRSSSRKLTNFNCRAQAPSTLPALGFAFNATSPQFATLFTPLLLPSTGPNPNITVPVINDTISTGTGIRIQVAGIYQISYTLTISLDNVPVTPEAARFFLTLNSSTNIIAGSGTAVRSNIIGTGEVDVSSGVILINLNPGDLIQIVPVEVIGTVDIRSAALTVAQIR

SEQ ID NO: 114 - protein, 796 aa, Bacillus thuringiensis
MSKKPFKVLSSIALTAVLGLSFGAGTQSAYAETPVNKTATSPVDDHLIPEERLADALKKRGVIDSKASETETKKAVEKYVENKKGENPGKEAANGDQLTKDASDFLKKVKDAKADTKEKLNQPATGTPAATGPVKGGLNGKVPTSPAKQKDYNGEVRKDKVLVLLVEYADFKHNNIDKEPGYMYSNDFNKEHYEKMLFGNEPFTLDDGSKIETFKQYYEEQSGGSYTVDGTVTKWLTVPGKAADYGADAPGGGHDNKGPKGPRDLVKDALKAAVDSGIDLSEFDQFDQYDVNGDGNKNQPDGLIDHLMIIHAGVGQEAGGGKLGDDAIWSHRWTVGPKPFPIEGTQAKVPYWGGKMAAFDYTIEPEDGAVGVFAHEYGHDLGLPDEYDTQYSGQGEPIEAWSIMSGGSWAGKIAGTTPTSFSPQNKEFFQKTIGGNWANIVEVDYEKLNKGIGLATYLDQSVTKSARPGMIRVNLPDKDVKTIEPAFGKQYYYSTKGDDLHTKMETPLFDLTNATSAKFDFKSLYEIEAGYDFLEVHAVTEDGKQTLIERLGEKANSGNADSTNGKWIDKSYDLSQFKGKKVKLTFDYITDGGLALNGFALDNASLTVDGKVVFSDDAEGTPQLKLDGFVVSNGTEKKKHNYYVEWRNYAGADNALKFARGPVFNTGMVVWYADSAYTDNWVGVHPGHGFLGVVDSHPEAIVGTLNGKPTVKSSTRFQIADAAFSFDKTPAWKVVSPTRGTFTYDGLAGVPKFDDSKTYINQQIPDAGRILPKLGLKFEVVGQADDNSAGAVRLYR

SEQ ID NO: 115 - protein, 430 aa, Bacillus cereus
MKHNDCFDHNNCNPIVFSADCCKNPQSVPITREQLSQLITLLNSLVSAISAFFANPSNANRLVLLDLFNQFLIFLNSLLPSPEVNFLKQLTQSIIVLLQSPAPNLGQLSTLLQQFYSALAQFFFALDLIPISCNSNVDSATLQLLFNLLIQLINATPGATGPTGPTGPTGPTGPAGTGAGPTGATGATGATGPTGATGPAGTGGATGATGATGVTGATGATGATGPTGPTGATGPTGATGATGATGPTGATGPTGATGLTGATGAAGGGAIIPFASGTTPSALVNALVANTGTLLGFGFSQPGVALTGGTSITLALGVGDYAFVAPRAGTITSLAGFFSATAALAPISPVQVQIQILTAPAASNTFTVQGAPLLLTPAFAAIAIGSTASGIIAEAIPVAAGDKILLYVSLTAASPIAAVAGFVSAGINIV

SEQ ID NO: 116 - protein, 437 aa, Bacillus cereus
MKHNDCFGHNNCNNPIVFTPDCCNNPQTVPITSEQLGRLITLLNSLIAAIAAFFANPSDANRLALLNLFTQLLNLLNELAPSPEGNFLKQLIQSIINLLQSPNPNLGQLLSLLQQFYSALAPFFFSLILDPASLQLLLNLLAQLIGVTPGGGATGPTGPTGPGGGATGPTGPTGPGGGATGPTGATGPTGDTGLAGATGATGPTGDTGVAGPAGPTGPTGDTGLAGATGPTGPTGDTGLAGATGPTGATGLAGATGPTGATGLTGATGATGAAGGGAIIPFASGTTPAALVNALIANTGTLLGFGFSQPGIGLAGGTSITLALGVGDYAFVAPRDGVITSLAGFFSATAALSPLSPVQVQIQILTAPAASNTFTVQGAPLLLTPAFAAIAIGSTASGIIPEAIPVVAGDKILLYVSLTAASPIAAVAGFVSAGINIV

SEQ ID NO: 117 - protein, 119 aa, Bacillus anthracis
MLFTSWLLFFIFALAAFRLTRLIVYDKITGFLRRPFIDELEITEPDGSVSTFTKVKGKGLRKWIGELLSCYWCTGVWVSAFLLVLYNWIPIVAEPLLALLAIAGAAAIIETITGYFMGE

SEQ ID NO: 118 - protein, 61 aa, Bacillus anthracis
MFAVSNNPRQNSYDLQQWYHMQQQHQAQQQAYQEQLQQQGFVKKKGCNCGKKKSTIKHYEE

SEQ ID NO: 119 - protein, 481 aa, Bacillus anthracis
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPTGPTGPAGATGATGPQGVQGPAGATGATGPQGVQGPAGATGATGPQGAQGPAGATGATGPQGAQGPAGATGATGPQGIQGPAGATGATGPQGVQGPTGATGIGVTGPTGPSGGPAGATGPQGPQGNTGATGPQGIQGPAGATGATGPQGAQGPAGATGATGPQGVQGPTGATGIGVTGPTGPSGPSFPVATIVVTNNIQQTVLQFNNFIFNTAINVNNIIFNGTDTVTVINAGIYVISVSISTTAPGCAPLGVGISINGAVATDNFSSNLIGDSLSFTTIETLTAGANISVQSTLNEITIPATGNTNIRLTVFRIA

SEQ ID NO: 120 - protein, 275 aa, Bacillus thuringiensis
MKMKRGITTLLSVAVLSTSLVACSGITEKTVAKEEKVKLTDQQLMADLWYQTAGEMKALYYQGYNIGQLKLDAVLAKGTEKKPAIVLDLDETVLDNSPHQAMSVKTGKGYPYKWDDWINKAEAEALPGAIDFLKYTESKGVDIYYISNRKTNQLDATIKNLERVGAPQATKEHILLQDPKEKGKEKRRELVSQTHDIVLFFGDNLSDFTGFDGKSVKDRNQAVADSKAQFGEKFIIFPNPMYGDWEGALYDYDFKKSDAEKDKIRRDNLKSFDTK

SEQ ID NO: 121 - protein, 795 aa, Bacillus thuringiensis
MKKKKKLKPLAVLTTAAVLSSTFAFGGHAAYAETPTSSLPIDEHLIPEERLAEALKQRGVIDQSASQAETSKAVEKYVEKKKGENPGKEILTGDSLTQEASDFMKKVKDAKMRENEQAQQPEVGPVAGQGAALNPGKLNGKVPTTSAKQEEYNGAVRKDKVLVLLVEFSDFKHNNIDQEPGYMYSKDFNREHYQKMLFGDEPFTLFDGSKINTFKQYYEEQSGGSYTVDGTVTEWLTVPGKASDYGADAGTGHDNKGPLGPKDLVKEALKAAVAKGINLADFDQYDQYDQNGNGNKNEPDGIIDHLMVVHAGVGQEAGGGKLKDDAIWSHRSKLGSKPYAIDGTKSSVSNWGGKMAAYDYTIEPEDGAVGVFAHEYGHDLGLPDEYDTKYSGQGEPVESWSIMSGGSWAGKIAGTEPTSFSPQNKEFFQKNMKGNWANILEVDYDKLSKGIGVATYVDQSTTKSKRPGIVRVNLPDKDIKNIESAFGKKFYYSTKGNDIHTTLETPVFDLTNAKDAKFDYKAFYELEAKYDFLDVYAIAEDGTKTRIDRMGEKDIKGGADTTDGKWVDKSYDLSQFKGKKVKLQFEYLTDIAVAYKGFALDNAALTVDGKVVFSDDAEGQPAMTLKGFTVSNGFEQKKHNYYVEWRNYAGSDTALQYARGPVFNTGMVVWYADQSFTDNWVGVHPGEGFLGVVDSHPEAIVGTLNGQPTVKSSTRYQIADAAFSFDQTPAWKVNSPTRGIFDYKGLPGVAKFDDSKQYINSVIPDAGRKLPKLGLKFEVVGQAEDKSAGAVWLHR

SEQ ID NO: 122 - protein, 798 aa, Bacillus mycoides
KRKTPFKVFSSLAITTMLGCTFALGTSVAYAETTSQSKGSISTTPIDNNLIQEERLAEALKERGTIDQSASKEETQKAVEQYIEKKKGDQPNKEILPDDPAKEASDFVKKVKEKKMEEKEKVKKSVENASSEQTPSQNKKQLNGKVPTSPAKQAPYNGAVRTDKVLVLLVEFSDYKHNNIEQSPGYMYANDFSREHYQKMLFGNEPFTLFDGSKVKTFKQYYEEQSGGSYTTDGYVTEWLTVPGKAADYGADGKTGHDNKGPKGARDLVKEALKAAAEKGLDLSQFDQFDRYDTNGDGNQNEPDGVIDHLMVIHAGVGQEAGGGKLGDDAIWSHRSKLAQDPVAIEGTKSKVSYWDGKVAAHDYTIEPEDGAVGVFAHEFGHDLGLPDEYDTNYTGAGSPVEAWSLMSGGSWTGRIAGTEPTSFSPQNKDFLQKNMDGNWAKIVEVDYDKIKRGVGFPTYIDQSVTKSNRPGLVRVNLPEKSVETIKTGFGKHAYYSTRGDDMHTTLETPLFDLTKAANAKFDYKANYELEAECDFIEVHAVTEDGTKTLIDKLGDKVVKGDQDTTEGKWIDKSYDLSQFKGKKVKLQFDYITDPALTYKGFAMDNVNVTVDGKVVFSDDAEGQAKMKLNGFVVSDGTEKKPHYYYLEWRNYAGSDEGLKVGRGPVYNTGLVVWYADDSFKDNWVGRHPGEGFLGVVDSHPEAVVGNLNGKPVYGNTGLQIADAAFSLDQTPAWNVNSFTRGQFNYPGLPGVATFDDSKVYSNTQIPDAGRKVPQLGLKFQVVGQADDKSAGAIWIRR

SEQ ID NO: 123 - DNA, 300 bp, Bacillus cereus
taactcaatcttaagagaaattgaggagcgcgcaccacttcgtcgtacaacaacgcaagaagaagttggggatacagcagtattcttattcagtgatttagcacgcggcgtaacaggagaaaacattcacgttgattcagggtatcatatcttaggataaatataatattaattttaaaggacaatctctacatgttgagattgtcctttttatttgttcttagaaagaacgatttttaacgaaagttcttaccacgttatgaatataagtataatagtacacgatttattcagctacgt

SEQ ID NO: 124 - DNA, 172 bp, Bacillus cereus
acgttgattcagggtatcatatcttaggataaatataatattaattttaaaggacaatctctacatgttgagattgtcctttttatttgttcttagaaagaacgatttttaacgaaagttcttaccacgttatgaatataagtataatagtacacgatttattcagctacgt

SEQ ID NO: 125 - DNA, 291 bp, Bacillus cereus
cataaaaatctacttttcttgtcaaagagtatgcttatatgcgtgctctttttatttggttttctttcatttctaaataacattttcaactctattcatactattctttcaactttaggttacaaactatttctgtaagcgtagtgtttcttttgtactataggcagttagttttatccataacagtacacctctgcactattcactataaattttcatatattatattgtgcttgtccaaaacatgtggttattactcacgcgatctaaatgaaagaaaggagtgaaaat

SEQ ID NO: 126 - DNA, 94 bp, Bacillus cereus
actattcactataaattttcatatattatattgtgcttgtccaaaacatgtggttattactcacgcgatctaaatgaaagaaaggagtgaaaat

SEQ ID NO: 127 - DNA, 300 bp, Bacillus thuringiensis
aatacatgataatgaaatccgattttgtgttttatatagtgaattatcaaatattgtgtagatgaaacaaagataaaatccccattaaactccctctatggaaattataaattgttcgataaaaactttcaatattttcagaaaacattgttgaattgtgatatattcgtatgctaactatgaaatttttacaaatatattaaaaacattacataatatgactaaatattgaaaaaatattgaatttttaataaaatttaatttgtaatacatattatttattaggggaggaaataaggg

SEQ ID NO: 128 - DNA, 48 bp, Bacillus thuringiensis
aaaatttaatttgtaatacatattatttattaggggaggaaataaggg

SEQ ID NO: 129 - DNA, 300 bp, Bacillus mycoides
aattgtgcatattgtcttttaaattttctatctaagttatttaatatataataaataactcttttttgtgagtttttttgatacgaggtaaataatcagtacagggtctgaccagaggactggagggcatgattctataagggaatatttactattccatgattatagaactatgtcttttttattgtatatagaaggggggataggtctatattatagaacttatatatattgtgcattccatattatcaattatctaaattttaagtcttgttacaattaataagggaggaaatagta

SEQ ID NO: 130 - DNA, 80 bp, Bacillus mycoides
acttatatatattgtgcattccatattatcaattatctaaattttaagtcttgttacaattaataagggaggaaatagta

SEQ ID NO: 131 - DNA, 141 bp, Bacillus thuringiensis
aatgacgttttcaagtttgattatcattcatgtttcctattttaagagaaacatataactcaactacttttttcaatggcatcttttatagtacttagaataggaaaacactcaactataagaaaagtaaggaggaaataa

SEQ ID NO: 132 - DNA, 79 bp, Bacillus thuringiensis
actacttttttcaatggcatcttttatagtacttagaataggaaaacactcaactataagaaaagtaaggaggaaataa

SEQ ID NO: 133 - DNA, 300 bp, Bacillus cereus
atatgctaatgcttagtttttatactcaagttaaaatgtgcttttggacctaagagataaacgtggaaaaataaaataaactcttaagtttaggtgtttaatctaagcagtcaattattaaaaacatataattaatatgtgagtcatgaacataattaaataatgttttcaagtttaattatcgttcatgtttcctattttaagcagaacaaataactcaattacttttttcgattggatcttttttaactcttataataggaaaacactcaactataaaaataagtaaggaggaaataa

SEQ ID NO: 134 - DNA, 167 bp, Bacillus cereus
aatatgtgagtcatgaacataattaaataatgttttcaagtttaattatcgttcatgtttcctattttaagcagaacaaataactcaattacttttttcgattggatcttttttaactcttataataggaaaacactcaactataaaaataagtaaggaggaaataa

SEQ ID NO: 135 - DNA, 300 bp, Bacillus thuringiensis
tataaaataaaagggcgtgtatttgctactgatgcagtattgtgtgcgcctaaaaatggaatttcacaaccagatccacatgttgttgtagaacaatcttgtaattcattgatgaattttacaacgtcaactacacaatgagaagagccatggtgtttattttcgttacaactcattaatgtcactccttatcttcttgtttgtatttacattaataagatattggagttgaggagatttggtcacaatctcaagaccttttttttaaataggcgaaagaggataagggaaggtggaatt

SEQ ID NO: 136 - DNA, 106 bp, Bacillus thuringiensis
tcttgtttgtatttacattaataagatattggagttgaggagatttggtcacaatctcaagaccttttttttaaataggcgaaagaggataagggaaggtggaatt

SEQ ID NO: 137 - DNA, 300 bp, Bacillus thuringiensis
atcaacttttacaaaagtaaagggtaaaggattaagaaagtggattggcgaattattaagctgttattggtgtacaggtgtatgggttagtgcttttttattagttttatataattggattccgatcgttgcagagccgttacttgcattattagctattgcaggagcagcagcaatcattgaaacgattacaggatattttatgggagaataatatattttcataatacgagaaaaagcggagtttaaaagaatgagggaacggaaataaagagttgttcatatagtaaatagacagaa

SEQ ID NO: 138 - DNA, 39 bp, Bacillus thuringiensis
acggaaataaagagttgttcatatagtaaatagacagaa

SEQ ID NO: 139 - DNA, 300 bp, Bacillus anthracis
tgaagtatctagagctaatttacgcaaaggaatctcaggacaacactttcgcaacacctatattttaaatttaataaaaaaagagactccggagtcagaaattataaagctagctgggttcaaatcaaaaatttcactaaaacgatattatcaatacgcagaaaatggaaaaaacgccttatcataaggcgttttttccattttttcttcaaacaaacgattttactatgaccatttaactaatttttgcatctactatgatgagtttcattcacattctcattagaaaggagagattta

SEQ ID NO: 140 - DNA, 70 bp, Bacillus anthracis
accatttaactaatttttgcatctactatgatgagtttcattcacattctcattagaaaggagagattta

SEQ ID NO: 141 - DNA, 300 bp, Bacillus cereus
gactatgtttattcaggataaaatatagcactacactctctcctcttattatgtagcatctctctaatccatcatttgtttcatttagttaaaattgtaaataaaatcacatgatttgtcaattataattgtcatttcgacaattaaacttgtcaaaataattctcatcattttttctcatctttctaatataggacatactactatatatacaaaagacaatatgcaaatgttcatacaaaaaatattatttttcgatatataatattaactgattttctaacatcaaggagggtacat

SEQ ID NO: 142 - DNA, 84 bp, Bacillus cereus
agacaatatgcaaatgttcatacaaaaaatattatttttcgatatataatattaactgattttctaacatcaaggagggtacat

SEQ ID NO: 143 - DNA, 300 bp, Bacillus thuringiensis
atagtgagtaatatggtaatccatagattaaatagtatagaaaatatttaattcttatttttattaaaaaagcatgaatcccagatttactgggttttgattgtaactaagaacatataaaagttcactgttatttataggagagtctgtttgtttttatatcttatgtatttcaccctgcataaaaaaatatttctcaacattttatttgttgaaaaatattgaatattcgtattataacgaatattatgttgttatcggcaaaaaacgataatttgcagacactggggaggaaataca

SEQ ID NO: 144 - DNA, 139 bp, Bacillus thuringiensis
tcttatgtatttcaccctgcataaaaaaatatttctcaacattttatttgttgaaaaatattgaatattcgtattataacgaatattatgttgttatcggcaaaaaacgataatttgcagacactggggaggaaataca

SEQ ID NO: 145 - DNA, 300 bp, Bacillus cereus
cttcgtcagcaataagtgtgagcggagaattggttgatcttggctttacaattggagcattgacgaaagactctttaacgtggtcgcataacggagtagaatatatgctcgtgtctaaaggtttagagccgaaggagctattaatggttgctcgttcagttacagagaagcaagtgaagtaaacttcttagacgtggtgatatatgtgcaccacgtcttttcttagtttgaagggtggatttcataaaagaagcatataaaagaataagcttcgcatatcgtgtataaggaagtgtattt

SEQ ID NO: 146 - DNA, 44 bp, Bacillus cereus
ataaaagaataagcttcgcatatcgtgtataaggaagtgtattt

SEQ ID NO: 147 - DNA, 300 bp, Bacillus thuringiensis
catttcaaataatgaacgcttcgattgaatcggagctattttcaaatcaatttcagtatattgatccagcatttgaatagaagtatcaacagcaactttaagttgatgcaatgcagattgtacaaacattgtaattctcctcttctccgtatataatagtttcttgagggtattatatcatgctcaaaattccgaaaattctagtagtttgactagcatattgaaaagtattatattgtaaaaggtcatatgaaacgtgaaatagaatggaatgcaattattgagttaggagttagacca

SEQ ID NO: 148 - DNA, 70 bp, Bacillus thuringiensis
ttatattgtaaaaggtcatatgaaacgtgaaatagaatggaatgcaattattgagttaggagttagacca

SEQ ID NO: 149 - DNA, 300 bp, Bacillus cereus
atcgatggaacctgtatcaaccactataatttcatccacaattttttcaactgagtctaaacaacgggctattgtcttctcctcatctcgaacaatcatacataaactaattgtaattccttgcttgttcaacataatcaccctcttccaaatcaatcatatgttatacatatactaaactttccatttttttaaattgttcaagtagtttaagatttcttttcaataattcaaatgtccgtgtcattttctttcggttttgcatctactatataatgaacgctttatggaggtgaattt

SEQ ID NO: 150 - DNA, 150 bp, Bacillus cereus
aatcaatcatatgttatacatatactaaactttccatttttttaaattgttcaagtagtttaagatttcttttcaataattcaaatgtccgtgtcattttctttcggttttgcatctactatataatgaacgctttatggaggtgaattt

SEQ ID NO: 151 - DNA, 300 bp, Bacillus thuringiensis
gacctgtaagtctgtagggaagaataatttcaagagccagtgataatagatttttttgttttttcattcttatcttgaatataaatcacctcatcttttaattagaacgtaaccaatttagtattttgaaatagagctatcattttataatatgaatactactagttatagaaacggcaaaaagtttaatatatgtaaaaatcatttggatatgaaaaaagtagccatagattttttcgaaatgataaatgttttattttgttaattaggaaacaaaaatgtggaatgagggggatttaa

SEQ ID NO: 152 - DNA, 91 bp, Bacillus thuringiensis
atatgaaaaaagtagccatagattttttcgaaatgataaatgttttattttgttaattaggaaacaaaaatgtggaatgagggggatttaa

SEQ ID NO: 153 - DNA, 300 bp, Bacillus anthracis
ttttcatctgctacatcgtgaagtaatgctgccatttcaattataaaacgatttcctccttcttgctcggataaagaaatcgccagtttatgtacacgctcaatatgataccaatcatgcccactggcatctttttctaaaatatgttttacaaaagtaattgttttttctatcttttcttgttttgtcattttatcttcacccagttacttattgtaacacgcccgcattttttcatcacatattttcttgtccgcccatacactaggtggtaggcatcatcatgaaggaggaatagat

SEQ ID NO: 154 - DNA, 61 bp, Bacillus anthracis
acatattttcttgtccgcccatacactaggtggtaggcatcatcatgaaggaggaatagat

SEQ ID NO: 155 - DNA, 300 bp, Bacillus anthracis
ggtgacgacaacatatacaagaggcactcctgctggtactgtaacaggaacaaatatggggcaaagtgtaaatacatcgggtatagcacaagctgtcccgaatacagataatatggattcaacggcgggactcccttaagaaattaggggagtctttatttggaaaaagagcttatgttacataaaaacaggagtaattgttttaaaagtagtattggtgacgttgttagaaaatacaatttaagtagaaggtgcgtttttatatgaaatatattttatagctgtactttacctttcaag

SEQ ID NO: 156 - DNA, 213 bp, Bacillus anthracis
acaagctgtcccgaatacagataatatggattcaacggcgggactcccttaagaaattaggggagtctttatttggaaaaagagcttatgttacataaaaacaggagtaattgttttaaaagtagtattggtgacgttgttagaaaatacaatttaagtagaaggtgcgtttttatatgaaatatattttatagctgtactttacctttcaag

SEQ ID NO: 157 - DNA, 300 bp, Bacillus anthracis
atttatttcattcaatttttcctatttagtacctaccgcactcacaaaaagcacctctcattaatttatattatagtcattgaaatctaatttaatgaaatcatcatactatatgttttataagaagtaaaggtaccatacttaattaatacatatctatacacttcaatatcacagcatgcagttgaattatatccaactttcatttcaaattaaataagtgcctccgctattgtgaatgtcatttactctccctactacatttaataattatgacaagcaatcataggaggttactac

SEQ ID NO: 158 - DNA, 180 bp, Bacillus anthracis
taagaagtaaaggtaccatacttaattaatacatatctatacacttcaatatcacagcatgcagttgaattatatccaactttcatttcaaattaaataagtgcctccgctattgtgaatgtcatttactctccctactacatttaataattatgacaagcaatcataggaggttactac

SEQ ID NO: 159 - DNA, 300 bp, Bacillus cereus
agttgtacaagaatttaaatcttcacaaacatatgtaaatgacttactacagctagttgcaagtacgatttctaacaacgtaacagatgaaatattaatttcaactaatggcgatgtattgaagggtgaaacgggcgcagcggtagaaagtaaaaaaggaaattgtggttgttaaagagatgtcgaaatgacatctctttttttagtggattaaacgtaagttcttctcaaaaaaagaatgacacattccgctattgtcacgcatatgattaagtgaatagtgattgaggagggttacga

SEQ ID NO: 160 - DNA, 57 bp, Bacillus cereus
acattccgctattgtcacgcatatgattaagtgaatagtgattgaggagggttacga

SEQ ID NO: 161 - DNA, 300 bp, Bacillus cereus
aacgttattagcgtagacaaacaagtaacggcagaagcagttcttgcattaaatcgtatgttagagcgtgtgtaaagcaacggtattcccgttgctttttttcatacatataatcataacgagaacgaaatgggcatacattgttttgaagaaatcattgtggttctttatgcttattccacttcgaatgatattgaaaatcgaagaagtgataaaagtaaaaagaagttaatgttatttagaaagagttacttcatgagatttgttacttatagataagttatacaggagggggaaaat

SEQ ID NO: 162 - DNA, 47 bp, Bacillus cereus
tcatgagatttgttacttatagataagttatacaggagggggaaaat

SEQ ID NO: 163 - DNA, 300 bp, Bacillus thuringiensis
aagccgcggtcaatgctgtatatgcaaataagattgcagctttacctgaagaagagcgtgatagcttcattgctgaaaaacgagaagagtataagaaagatattgatatttaccatttagcatcagagatggtcattgatggtattgttcatccaaacaatttaagagaagagttaaaaggacgattcgaaatgtatatgagtaaatatcaagtatttacggatcgtaaacatcctgtttatccagtttaaaagccctatttagggctttcttgctcaaaaagttaaggaggggaaaaca

SEQ ID NO: 164 - DNA, 92 bp, Bacillus thuringiensis
tcaagtatttacggatcgtaaacatcctgtttatccagtttaaaagccctatttagggctttcttgctcaaaaagttaaggaggggaaaaca

SEQ ID NO: 165 - DNA, 300 bp, Bacillus cereus
aggatttcagtgggacgcctcctctcttcttacattaaattaatcatactataaaatgaaagaaatgaaatgaaaaatagcggaaaaatcagaaattttttctggtagtatacaatatgttacaataagctttgtcaatgaaagaaggaattccgtgcaatgcacgggagaggttcgcgaactccctctataaaaaactatggaaacaacaatatctttaggtattgttttgtttttttattgtgacagttcaagaacgttctttcttcttattcgtagtagagaaggagaatgagtgaa

SEQ ID NO: 166 - DNA, 104 bp, Bacillus cereus
actatggaaacaacaatatctttaggtattgttttgtttttttattgtgacagttcaagaacgttctttcttcttattcgtagtagagaaggagaatgagtgaa

SEQ ID NO: 167 - DNA, 300 bp, Bacillus cereus
ttttgcacaacgccgtaaaactttaatgaataatttatcaaataatttaaatggtttcccgaaagataaagagctgttggatcgaattttaacagaagtaggaattgatccaaaacgaagaggcgaaacgctatctatcgaagagtttgcgacattaagtaatgcattagttcttcataagttatcataagaatacaaaagggacagttcaatttgaactgtcccttttgtcacctttctcctcctaaattcatactttaaaaacaggtaagatggcctaacgagtttggaggtaggaga

SEQ ID NO: 168 - DNA, 63 bp, Bacillus cereus
tctcctcctaaattcatactttaaaaacaggtaagatggcctaacgagtttggaggtaggaga

SEQ ID NO: 169 - DNA, 300 bp, Bacillus thuringiensis
ggaaacagaagtcatcccatttgaaaatgcagcaggtcgtattatagctgatttcgttatggtttatccgccagggattccaatctttactccgggggaaattattacacaagacaacttagagtatattcgtaaaaacttagaagcaggtttacctgtacaaggtcctgaagatatgacattacaaacattacgcgtgatcaaagagtacaagcctatcagttgataggctttttttcaccctttttcccttttctcatacgatattatgtaatgtaacgtataggtggggatactact

SEQ ID NO: 170 - DNA, 61 bp, Bacillus thuringiensis
accctttttcccttttctcatacgatattatgtaatgtaacgtataggtggggatactact

SEQ ID NO: 171 - DNA, 300 bp, Bacillus cereus
attgtggacccttagctcagctggttagagcagacggctcataaccgtccggtcgtaggttcgagtcctacagggtccatatccatttcacatgtttattatgtcggcaggaagcttccttgtagaagggagctttttttatgaaatatatgagcattttaattgaaatgaagtgggaattttgctactttaatgatagcaagacaatgtgatttatttgtttgcaccctatggcaattagggtagaatgaagttgtatgtcacttaagtggcaatacataaactgggaggaatataaca

SEQ ID NO: 172 - DNA, 38 bp, Bacillus cereus
acttaagtggcaatacataaactgggaggaatataaca

SEQ ID NO: 173 - DNA, 300 bp, Bacillus cereus
aatataacagaaaattctgatgttttttcaaatcctataataaggagtgttccgtatgatgcctttatattttccggaagataaaacagaatatattattccagggattgtttgtgttctatttatcatcggtgcgattgctacgtggcgtatgttcattcgtgtatcaaaacgagaagcagagcgattacagaaagttgaagaaaagctgttagctgaaaagaaacagtaactcatttttgtatgtttccctctatgctcggacaatctaagggcagaatgtattttggagggaatgaa

SEQ ID NO: 174 - DNA, 228 bp, Bacillus cereus
tccggaagataaaacagaatatattattccagggattgtttgtgttctatttatcatcggtgcgattgctacgtggcgtatgttcattcgtgtatcaaaacgagaagcagagcgattacagaaagttgaagaaaagctgttagctgaaaagaaacagtaactcatttttgtatgtttccctctatgctcggacaatctaagggcagaatgtattttggagggaatgaa

SEQ ID NO: 175 - DNA, 166 bp, Bacillus anthracis
taatcaccctcttccaaatcaatcatatgttatacatatactaaactttccatttttttaaattgttcaagtagtttaagatttcttttcaataattcaaatgtccgtgtcattttctttcggttttgcatctactatataatgaacgctttatggaggtgaattt

SEQ ID NO: 176 - DNA, 173 bp, Bacillus anthracis
aattacataacaagaactacattagggagcaagcagtctagcgaaagctaactgcttttttattaaataactattttattaaatttcatatatacaatcgcttgtccatttcatttggctctacccacgcatttactattagtaatatgaatttttcagaggtggattttatt

SEQ ID NO: 177 - DNA, 121 bp, Bacillus weihenstephanensis
ctatgatttaagatacacaatagcaaaagagaaacatattatataacgataaatgaaacttatgtatatgtatggtaactgtatatattactacaatacagtatactcataggaggtaggt

SEQ ID NO: 178 - DNA, 373 bp, Bacillus weihenstephanensis
ggtaggtagatttgaaatatgatgaagaaaaggaataactaaaaggagtcgatatccgactccttttagttataaataatgtggaattagagtataattttatataggtatattgtattagatgaacgctttatcctttaattgtgattaatgatggattgtaagagaaggggcttacagtcctttttttatggtgttctataagcctttttaaaaggggtaccaccccacacccaaaaacagggggggttataactacatattggatgttttgtaacgtacaagaatcggtattaattaccctgtaaataagttatgtgtatataaggtaactttatatattctcctacaataaaataaaggaggtaataaa

SEQ ID NO: 179 - DNA, 225 bp, Bacillus thuringiensis
aacccttaatgcattggttaaacattgtaaagtctaaagcatggataatgggcgagaagtaagtagattgttaacaccctgggtcaaaaattgatatttagtaaaattagttgcactttgtgcattttttcataagatgagtcatatgttttaaattgtagtaatgaaaaacagtattatatcataatgaattggtatcttaataaaagagatggaggtaactta

SEQ ID NO: 180 - DNA, 115 bp, Bacillus thuringiensis
taattccaccttcccttatcctctttcgcctatttaaaaaaaggtcttgagattgtgaccaaatctcctcaactccaatatcttattaatgtaaatacaaacaagaagataagga

SEQ ID NO: 181 - DNA, 144 bp, Bacillus thuringiensis
aggatgtctttttttatattgtattatgtacatccctactatataaattccctgcttttatcgtaagaattaacgtaatatcaaccatatcccgttcatattgtagtagtgtatgtcagaactcacgagaaggagtgaacataa

SEQ ID NO: 182 - DNA, 125 bp, Bacillus thuringiensis
ttaatgtcactccttatcttcttgtttgtatttacattaataagatattggagttgaggagatttggtcacaatctcaagaccttttttttaaataggcgaaagaggataagggaaggtggaatt

SEQ ID NO: 183 - DNA, 87 bp, Bacillus thuringiensis
atatattttcataatacgagaaaaagcggagtttaaaagaatgagggaacggaaataaagagttgttcatatagtaaatagacagaa

SEQ ID NO: 184 - DNA, 168 bp, Bacillus thuringiensis
aaactaaataatgagctaagcatggattgggtggcagaattatctgccacccaatccatgcttaacgagtattattatgtaaatttcttaaaattgggaacttgtctagaacatagaacctgtccttttcattaactgaaagtagaaacagataaaggagtgaaaaac

SEQ ID NO: 185 - DNA, 111 bp, Bacillus thuringiensis
attcactacaacggggatgagtttgatgcggatacatatgagaagtaccggaaagtgtttgtagaacattacaaagatatattatctccatcataaaggagagatgcaaag

SEQ ID NO: 186 - DNA, 273 bp, Bacillus anthracis
cgcgcaccacttcgtcgtacaacaacgcaagaagaagttggggatacagcagtattcttattcagtgatttagcacgcggcgtaacaggagaaaacattcacgttgattcagggtatcatatcttaggataaatataatattaattttaaaggacaatctctacatgttgagattgtcctttttatttgttcttagaaagaacgatttttaacgaaagttcttaccacgttatgaatataagtataatagtacacgatttattcagctacgta

SEQ ID NO: 187 - DNA, 240 bp, Bacillus anthracis
tatatcatatgtaaaattagttcttattcccacatatcatatagaatcgccatattatacatgcagaaaactaagtatggtattattcttaaattgtttagcaccttctaatattacagatagaatccgtcattttcaacagtgaacatggatttcttctgaacacaactctttttctttccttatttccaaaaagaaaagcagcccattttaaaatacggctgcttgtaatgtacatta

SEQ ID NO: 188 - DNA, 267 bp, Bacillus thuringiensis
tatcacataactctttatttttaatatttcgacataaagtgaaactttaatcagtgggggctttgttcatccccccactgattattaattgaaccaagggataaaaagatagagggtctgaccagaaaactggagggcatgattctataacaaaaagcttaatgtttatagaattatgtctttttatatagggagggtagtaaacagagatttggacaaaaatgcaccgatttatctgaattttaagttttataaaggggagaaatg

SEQ ID NO: 189 - DNA, 124 bp, Bacillus thuringiensis
attttttacttagcagtaaaactgatatcagttttactgctttttcatttttaaattcaatcattaaatcttccttttctacatagtcataatgttgtatgacattccgtaggaggcacttata

SEQ ID NO: 190 - DNA, 170 bp, Bacillus thuringiensis
acataaattcacctccataaagcgttcattatatagtagatgcaaaaccgaaagaaaatgacacggacatttgaattattgaaaagaaatcttaaactacttgaacaatttaaaaaaatggaaagtttagtatatgtataacatatgattgatttggaagagggtgatta

SEQ ID NO: 191 - DNA, 212 bp, Bacillus thuringiensis
ttctattttccaacataacatgctacgattaaatggttttttgcaaatgccttcttgggaagaaggattagagcgtttttttatagaaaccaaaagtcattaacaattttaagttaatgacttttttgtttgcctttaagaggttttatgttactataattatagtatcaggtactaataacaagtataagtatttctgggaggatatatca

SEQ ID NO: 192 - protein, 180 aa, Bacillus cereus
MSEFREIITKAVVGKGRKYTKSTHTCESNNEPTSILGCWVINHSYEARKNGKHVEIEGFYDVNTWYSFDGNTKTEVVTERVNYTDEVSIGYRDKNFSGDDLEIIARVIQPPNCLEALVSPNGNKIVVTVEREFVTEVVGETKICVSVNPEGCVESDEDFQIDDDEFEELDPNFIVDAEEE

SEQ ID NO: 193 - protein, 155 aa, Bacillus thuringiensis
MTLMSCNENKHHGSSHCVVDVVKFINELQDCSTTTCGSGCEIPFLGAHNTASVANTRPFILYTKAGAPFEAFAPSANLTSCRSPIFRVESVDDDSCAVLRVLSVVLGDSSPVPPTDDPICTFLAVPNARLVSTSTCITVDLSCFCAIQCLRDVTI

SEQ ID NO: 194 - protein, 366 aa, Bacillus anthracis; identical to SEQ ID NO: 8

SEQ ID NO: 195 - protein, 347 aa, Bacillus anthracis
MQNDKLWLDKGIIGPENIGPTFPVLPPIHIPTGITGATGATGITGATGPTGTTGATGATGITGVTGATGITGVTGATGITGVTGATGITGVTGATGITGVTGPTGITGATGPTGTTGVTGPTGDTGLAGATGPTGATGLAGATGPTGDTGATGPTGATGLAGATGPTGATGLTGATGATGATGGGAIIPFASGTTPALLVNAVLANTGTLLGFGFSQPGIAPGVGGTLTILPGVVGDYAFVAPRDGIITSLAGFFSATAALAPLTPVQIQMQIFIAPAASNTFTPVAPPLLLTPALPAIAIGTTATGIQAYNVPVVAGDKILVYVSLTGASPIAAVAGFVSAGLNIV

SEQ ID NO: 196 - protein, 61 aa, Bacillus cereus; identical to SEQ ID NO: 118

SEQ ID NO: 197 - protein, 66 aa, Bacillus cereus
LTVEEMFAVSNNPRQNSYDLQQWYHMQQQHQAQQQAYQEQLQQQGFVKKKGCNCGKKKSTIKHYEE

SEQ ID NO: 198 - protein, 156 aa, Bacillus cereus; identical to SEQ ID NO: 111

SEQ ID NO: 199 - protein, 182 aa, Bacillus anthracis; identical to SEQ ID NO: 112

SEQ ID NO: 200 - DNA, 711 bp, Bacillus mycoides
  misc_feature (20)..(21): n is a, c, g, or t
ggagcacgccgcgtgagtgnngaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgttgggttaagtcccgc

SEQ ID NO: 201 - DNA, 719 bp, Bacillus mycoides
  misc_feature (630)..(630): n is a, c, g, or t
  misc_feature (640)..(642): n is a, c, g, or t
aaagtctgacggagcacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaacnctagagatannncttctccttcgggagcagagtgacaggtggtgcatggttgtcgtcagctcgtgtcgtgagatgttgggttaagtccc

SEQ ID NO: 202 - DNA, 709 bp, Bacillus mycoides
ggagcacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtccc

SEQ ID NO: 203 - DNA, 713 bp, Bacillus cereus
  misc_feature (4)..(4): n is a, c, g, or t
  misc_feature (22)..(22): n is a, c, g, or t
  misc_feature (697)..(697): n is a, c, g, or t
ggancaacgccgcgtgagtgangaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgntgggttaagtcccgca

SEQ ID NO: 204 - DNA, 686 bp, Bacillus cereus
aaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcc

SEQ ID NO: 205 - DNA, 717 bp, Bacillus mycoides
  misc_feature (7)..(7): n is a, c, g, or t
  misc_feature (11)..(11): n is a, c, g, or t
gtctganggancacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccg

SEQ ID NO: 206 - DNA, 720 bp, Bacillus cereus
  misc_feature (2)..(2): n is a, c, g, or t
  misc_feature (10)..(10): n is a, c, g, or t
tntgacggancacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaac

SEQ ID NO: 207 - DNA, 616 bp, Bacillus thuringiensis
  misc_feature (6)..(6): n is a, c, g, or t
  misc_feature (9)..(9): n is a, c, g, or t
  misc_feature (12)..(12): n is a, c, g, or t
  misc_feature (28)..(28): n is a, c, g, or t
  misc_feature (33)..(33): n is a, c, g, or t
  misc_feature (39)..(39): n is a, c, g, or t
  misc_feature (45)..(45): n is a, c, g, or t
  misc_feature (79)..(80): n is a, c, g, or t
  misc_feature (87)..(87): n is a, c, g, or t
  misc_feature (105)..(105): n is a, c, g, or t
  misc_feature (123)..(124): n is a, c, g, or t
  misc_feature (181)..(181): n is a, c, g, or t
  misc_feature (192)..(194): n is a, c, g, or t
  misc_feature (205)..(206): n is a, c, g, or t
  misc_feature (233)..(233): n is a, c, g, or t
  misc_feature (272)..(272): n is a, c, g, or t
  misc_feature (287)..(287): n is a, c, g, or t
  misc_feature (297)..(297): n is a, c, g, or t
  misc_feature (302)..(302): n is a, c, g, or t
  misc_feature (314)..(314): n is a, c, g, or t
  misc_feature (369)..(369): n is a, c, g, or t
  misc_feature (375)..(375): n is a, c, g, or t
  misc_feature (385)..(387): n is a, c, g, or t
  misc_feature (399)..(399): n is a, c, g, or t
  misc_feature (402)..(402): n is a, c, g, or t
  misc_feature (420)..(420): n is a, c, g, or t
  misc_feature (430)..(430): n is a, c, g, or t
  misc_feature (458)..(459): n is a, c, g, or t
  misc_feature (466)..(466): n is a, c, g, or t
  misc_feature (499)..(499): n is a, c, g, or t
  misc_feature (510)..(510): n is a, c, g, or t
  misc_feature (513)..(513): n is a, c, g, or t
  misc_feature (518)..(518): n is a, c, g, or t
  misc_feature (522)..(523): n is a, c, g, or t
  misc_feature (548)..(548): n is a, c, g, or t
  misc_feature (556)..(556): n is a, c, g, or t
  misc_feature (558)..(558): n is a, c, g, or t
  misc_feature (561)..(561): n is a, c, g, or t
  misc_feature (571)..(572): n is a, c, g, or t
  misc_feature (593)..(595): n is a, c, g, or t
  misc_feature (597)..(598): n is a, c, g, or t
  misc_feature (614)..(614): n is a, c, g, or t
ctttcnggncgnaaaactctgttgttanggaanaacaantgctanttgaataagctggcgccttgacggtacctaaccnnaaagccncggctaactacgtgccancagccgcggtaatacgtnngtggcaagcgttatccggaattattgggcgtaaagcgcgcgcaggtggtttcttaantctgatgtgannncccacggctcnnccgtggagggtcattggaaactggganacttgagtgcagaagaggaaagtggaattccatgtgtancggtgaaatgcgtanagatatggangaacnccagtggcgaangcgactttctggtctgtaactgacactgaggcgcgaaagcgtggggagcaaacangattanataccctggnnntccacgccgtanacnatgagtgctaagtgttanagggtttccnccctttagtgctgaagttaacgcattanncactccncctggggagtacggccgcaaggctgaaactcanaggaattgacnggngcccncacnngcggtggagcatgtggtttaattcnaagcaacncnaanaaccttaccnngtcttgacatcctctgaaaannntnnagatagggcttctccntc

SEQ ID NO: 208 - DNA, 703 bp, Bacillus cereus
  misc_feature (701)..(701): n is a, c, g, or t
cacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaantc

SEQ ID NO: 209 - DNA, 717 bp, Bacillus thuringiensis
  misc_feature (5)..(5): n is a, c, g, or t
  misc_feature (8)..(9): n is a, c, g, or t
ctganggnncaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgc

SEQ ID NO: 210 - DNA, 980 bp, Bacillus thuringiensis
  misc_feature (19)..(19): n is a, c, g, or t
  misc_feature (729)..(730): n is a, c, g, or t
  misc_feature (746)..(747): n is a, c, g, or t
  misc_feature (749)..(750): n is a, c, g, or t
  misc_feature (775)..(776): n is a, c, g, or t
  misc_feature (785)..(786): n is a, c, g, or t
  misc_feature (812)..(816): n is a, c, g, or t
  misc_feature (835)..(837): n is a, c, g, or t
  misc_feature (840)..(840): n is a, c, g, or t
  misc_feature (846)..(847): n is a, c, g, or t
  misc_feature (851)..(853): n is a, c, g, or t
  misc_feature (884)..(890): n is a, c, g, or t
  misc_feature (893)..(893): n is a, c, g, or t
  misc_feature (896)..(897): n is a, c, g, or t
  misc_feature (902)..(902): n is a, c, g, or t
  misc_feature (907)..(907): n is a, c, g, or t
  misc_feature (911)..(912): n is a, c, g, or t
  misc_feature (915)..(915): n is a, c, g, or t
  misc_feature (923)..(925): n is a, c, g, or t
  misc_feature (931)..(931): n is a, c, g, or t
  misc_feature (937)..(939): n is a, c, g, or t
  misc_feature (942)..(944): n is a, c, g, or t
  misc_feature (946)..(950): n is a, c, g, or t
  misc_feature (952)..(954): n is a, c, g, or t
  misc_feature (956)..(956): n is a, c, g, or t
  misc_feature (972)..(972): n is a, c, g, or t
  misc_feature (975)..(975): n is a, c, g, or t
tggacgaagtctgacggancacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaannggccgcaacccaacanncnncgacacgagctgacgacaaccatgnnccaccagtnnctctgctctcgaaggagaagccccannnnnagggtttttcgaggatgtnnnganctggtnngggnnntcgcgttgcttcgaattaaaccacatgctcnnnnnnntgnggnnccccnagtcnattnnttngagtctannnctgganccggannnaannngnnnnngnnnanttgcgttaattggggnaancccgg

SEQ ID NO: 211 - DNA, 731 bp, Bacillus mycoides
  misc_feature (7)..(8): n is a, c, g, or t
  misc_feature (12)..(12): n is a, c, g, or t
  misc_feature (28)..(29): n is a, c, g, or t
  misc_feature (723)..(723): n is a, c, g, or t
  misc_feature (725)..(727): n is a, c, g, or t
agtctgnnggancacgccgcgtgagtgnngaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacnannngcaa

SEQ ID NO: 212 - DNA, 714 bp, Bacillus pseudomycoides
  misc_feature (5)..(5): n is a, c, g, or t
  misc_feature (9)..(9): n is a, c, g, or t
  misc_feature (701)..(701): n is a, c, g, or t
  misc_feature (706)..(706): n is a, c, g, or t
ctganggancacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgntgggntaagtccc

SEQ ID NO: 213 - DNA, 740 bp, Bacillus cereus
  misc_feature (5)..(6): n is a, c, g, or t
  misc_feature (10)..(10): n is a, c, g, or t
  misc_feature (15)..(15): n is a, c, g, or t
  misc_feature (32)..(32): n is a, c, g, or t
  misc_feature (703)..(703): n is a, c, g, or t
  misc_feature (724)..(724): n is a, c, g, or t
  misc_feature (733)..(734): n is a, c, g, or t
  misc_feature (736)..(740): n is a, c, g, or t
tctgnnggancaacnccgcgtgagtgatgaangctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgntgggttaagtcccgcaacganccgcaaccnnannnnn

SEQ ID NO: 214 - DNA, 876 bp, Bacillus thuringiensis
tctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgc

SEQ ID NO: 215 - DNA, 711 bp, Bacillus mycoides; identical to SEQ ID NO: 200
  misc_feature (20)..(21): n is a, c, g, or t

SEQ ID NO: 216 - DNA, 712 bp, Bacillus megaterium
  misc_feature (4)..(4): n is a, c, g, or t
  misc_feature (69)..(69): n is a, c, g, or t
  misc_feature (82)..(82): n is a, c, g, or t
ggancacgccgcgtgagtgatgaaggctttcgggtcgtaaaactctgttgttagggaagaacaagtacnagagtaactgctngtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgc

SEQ ID NO: 217 - DNA, 714 bp, Bacillus sp.
  misc_feature (4)..(4): n is a, c, g, or t
  misc_feature (16)..(19): n is a, c, g, or t
  misc_feature (21)..(22): n is a, c, g, or t
ggancacgccgcgtgnnnngnngaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaac

SEQ ID NO: 218 - DNA, 718 bp, Bacillus circulans
  misc_feature (9)..(9): n is a, c, g, or t
  misc_feature (13)..(13): n is a, c, g, or t
aagtctganggancacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcc

SEQ ID NO: 219 - DNA, 718 bp, Bacillus subtilis
  misc_feature (6)..(7): n is a, c, g, or t
  misc_feature (11)..(11): n is a, c, g, or t
gtctgnnggancacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgc

SEQ ID NO: 220 - DNA, 713 bp, Lysinibacillus fusiformis
  misc_feature (702)..(702): n is a, c, g, or t
  misc_feature (711)..(711): n is a, c, g, or t
ctgatggagcacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggtttccccttcgggggcaacggtgacaggtggtgcatggttgtcgtcagctcgtgtcgtgagatgntgggttaantc

SEQ ID NO: 221 - DNA, 715 bp, Lysinibcaillus sphaericus
  misc_feature (12)..(12): n is a, c, g, or t
  misc_feature (704)..(704): n is a, c, g, or t
  misc_feature (712)..(712): n is a, c, g, or t
ctgatggagcancgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgtngggttaantcc

SEQ ID NO: 222 - DNA, 717 bp, Bacillus aryabhattai
  misc_feature (3)..(4): n is a, c, g, or t
ggnncaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacg

SEQ ID NO: 223 - DNA, 718 bp, Bacillus aryabhattai
  misc_feature (6)..(6): n is a, c, g, or t
  misc_feature (9)..(10): n is a, c, g, or t
tctganggnncacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgc

SEQ ID NO: 224 - DNA, 716 bp, Bacillus flexus
  misc_feature (4)..(4): n is a, c, g, or t
  misc_feature (22)..(22): n is a, c, g, or t
ggancaacgccgcgtgagtgangaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaac

SEQ ID NO: 225 - DNA, 676 bp, Paracoccus kondratievae
  misc_feature (13)..(15): n is a, c, g, or t
  misc_feature (19)..(19): n is a, c, g, or t
  misc_feature (44)..(44): n is a, c, g, or t
gccgcgtgagtgnnnaagnccctagggttgtaaagctctttcanctgggaagataatgactgtaccagcagaagaagccccggctaactccgtgccagcagccgcggtaatacggagggggctagcgttgttcggaattactgggcgtaaagcgcacgtaggcggaccggaaagttgggggtgaaatcccggggctcaaccccggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggacagcccgagagatcgggtctccacttcggtggcctggagacaggtgctgcatggctgtcgtcagctcgtgtcgtgagatgttcggttaagtccggc

SEQ ID NO: 226 - DNA, 728 bp, Enterobacter cloacae
  misc_feature (4)..(5): n is a, c, g, or t
  misc_feature (12)..(12): n is a, c, g, or t
  misc_feature (33)..(33): n is a, c, g, or t
  misc_feature (719)..(719): n is a, c, g, or t
  misc_feature (721)..(722): n is a, c, g, or t
ctgnngcagccntgccgcgtgtatgaagaaggncttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacnanncgcaac

SEQ ID NO: 227 - DNA, 717 bp, Bacillus nealsonii
  misc_feature (3)..(4): n is a, c, g, or t
  misc_feature (8)..(8): n is a, c, g, or t
tgnnggancaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgc

SEQ ID NO: 228 - DNA, 702 bp, Bacillus subtilis
cgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcc

SEQ ID NO: 229 - DNA, 680 bp, Alcaligenes faecalis
  misc_feature (103)..(103): n is a, c, g, or t
  misc_feature (262)..(264): n is a, c, g, or t
  misc_feature (272)..(273): n is a, c, g, or t
cttcgggttgtaaagtacttttggcagagaagaaaaggtatctcctaatacgagatactgctgacggtatctgcagaataagcaccggctaactacgtgccancagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattcnnntgtagcanngaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtccc

SEQ ID NO: 230 - DNA, 640 bp, Paenibacillus massiliensis
  misc_feature (5)..(6): n is a, c, g, or t
  misc_feature (8)..(9): n is a, c, g, or t
  misc_feature (13)..(17): n is a, c, g, or t
  misc_feature (22)..(23): n is a, c, g, or t
  misc_feature (26)..(26): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (121)..(121): n is a, c, g, or t
  misc_feature (162)..(162): n is a, c, g, or t
  misc_feature (164)..(164): n is a, c, g, or t
  misc_feature (185)..(185): n is a, c, g, or t
  misc_feature (189)..(190): n is a, c, g, or t
  misc_feature (193)..(193): n is a, c, g, or t
  misc_feature (210)..(211): n is a, c, g, or t
  misc_feature (217)..(217): n is a, c, g, or t
  misc_feature (229)..(229): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (242)..(242): n is a, c, g, or t
  misc_feature (251)..(251): n is a, c, g, or t
  misc_feature (256)..(256): n is a, c, g, or t
  misc_feature (259)..(259): n is a, c, g, or t
  misc_feature (262)..(262): n is a, c, g, or t
  misc_feature (284)..(284): n is a, c, g, or t
  misc_feature (289)..(289): n is a, c, g, or t
  misc_feature (292)..(292): n is a, c, g, or t
  misc_feature (314)..(314): n is a, c, g, or t
  misc_feature (320)..(320): n is a, c, g, or t
  misc_feature (332)..(332): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (350)..(350): n is a, c, g, or t
  misc_feature (352)..(352): n is a, c, g, or t
  misc_feature (364)..(365): n is a, c, g, or t
  misc_feature (373)..(373): n is a, c, g, or t
  misc_feature (383)..(383): n is a, c, g, or t
  misc_feature (388)..(388): n is a, c, g, or t
  misc_feature (391)..(391): n is a, c, g, or t
  misc_feature (404)..(404): n is a, c, g, or t
  misc_feature (417)..(418): n is a, c, g, or t
  misc_feature (420)..(420): n is a, c, g, or t
  misc_feature (424)..(424): n is a, c, g, or t
  misc_feature (428)..(428): n is a, c, g, or t
  misc_feature (432)..(432): n is a, c, g, or t
  misc_feature (434)..(434): n is a, c, g, or t
  misc_feature (443)..(444): n is a, c, g, or t
  misc_feature (446)..(446): n is a, c, g, or t
  misc_feature (450)..(450): n is a, c, g, or t
  misc_feature (455)..(455): n is a, c, g, or t
  misc_feature (471)..(472): n is a, c, g, or t
  misc_feature (475)..(475): n is a, c, g, or t
  misc_feature (477)..(477): n is a, c, g, or t
  misc_feature (490)..(490): n is a, c, g, or t
  misc_feature (492)..(496): n is a, c, g, or t
  misc_feature (501)..(501): n is a, c, g, or t
  misc_feature (503)..(503): n is a, c, g, or t
  misc_feature (506)..(506): n is a, c, g, or t
  misc_feature (509)..(509): n is a, c, g, or t
  misc_feature (516)..(517): n is a, c, g, or t
  misc_feature (519)..(519): n is a, c, g, or t
  misc_feature (530)..(530): n is a, c, g, or t
  misc_feature (538)..(538): n is a, c, g, or t
  misc_feature (540)..(540): n is a, c, g, or t
  misc_feature (544)..(544): n is a, c, g, or t
  misc_feature (546)..(546): n is a, c, g, or t
  misc_feature (551)..(551): n is a, c, g, or t
  misc_feature (562)..(562): n is a, c, g, or t
  misc_feature (564)..(564): n is a, c, g, or t
  misc_feature (571)..(572): n is a, c, g, or t
  misc_feature (589)..(589): n is a, c, g, or t
  misc_feature (594)..(594): n is a, c, g, or t
  misc_feature (597)..(598): n is a, c, g, or t
  misc_feature (602)..(602): n is a, c, g, or t
  misc_feature (607)..(608): n is a, c, g, or t
  misc_feature (610)..(610): n is a, c, g, or t
  misc_feature (624)..(624): n is a, c, g, or t
  misc_feature (633)..(633): n is a, c, g, or t
  misc_feature (635)..(635): n is a, c, g, or t
  misc_feature (637)..(640): n is a, c, g, or t
cttanngnntgannnnncttgnnaanaaagccccggctaactacntgccancanccgcggtaatacntanggngcaagcgttgtccggaattattgggcgtaaagcgcgcgcaggcggtcntttaagtctggtgtttaagcccggggctcaaccccggatcncncgggaaactggatgacttgantgcnnaanaagagagtggaattccnngtgtancggtgaaatgcntananatgtgnangaacaccantggcnaangcnactctctgggctgtaactgacnctgangcncgaaagcgtggggagcaaacangattanataccctggtantccacgccntanacnatnantgctaggtgttnngggtttcnatacccttgntgccnaanttaacacattaancactccgcctggnnantacngtcncaanantgaaactcnnangaantgacngggacccgcacaagcnntgnantatgtggtttaantnnnnncaacncnaanaancttaccnngncttgacatctnaatgaccngngcananatgtncctttccttcngnacattcnngacaggtggtgcatggntgtcntcnnctcntgtcnngngatgttgggttaantccccgcancnannnn

SEQ ID NO: 231 - DNA, 678 bp, Bacillus subtilis
  misc_feature (425)..(425): n is a, c, g, or t
  misc_feature (548)..(548): n is a, c, g, or t
  misc_feature (640)..(640): n is a, c, g, or t
  misc_feature (661)..(661): n is a, c, g, or t
aagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttantgctgcagctaacgcattaagcactccgcctggggagtacggtcgcaagactgaaactcaaaggaattgacgggggcccgcacaagcggtggagcatgtggtttaattcgaagcaacgcgaanaaccttaccaggtcttgacatcctctgacaatcctagagataggacgtccccttcgggggcagagtgacaggtggtgcatggttgtcgtcanctcgtgtcgtgagatgttggnttaagtcccgcaacgag

SEQ ID NO: 232 - DNA, 743 bp, Bacillus megaterium
  misc_feature (4)..(4): n is a, c, g, or t
  misc_feature (12)..(13): n is a, c, g, or t
  misc_feature (689)..(691): n is a, c, g, or t
  misc_feature (693)..(708): n is a, c, g, or t
  misc_feature (712)..(712): n is a, c, g, or t
  misc_feature (716)..(717): n is a, c, g, or t
  misc_feature (720)..(720): n is a, c, g, or t
  misc_feature (727)..(727): n is a, c, g, or t
  misc_feature (729)..(730): n is a, c, g, or t
  misc_feature (734)..(734): n is a, c, g, or t
  misc_feature (740)..(741): n is a, c, g, or t
aagnctttcggnncgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccnnncnnnnnnnnnnnnnnnntctnaganncgngctgacnannccangcaccnngg

SEQ ID NO: 233 - DNA, 850 bp, Bacillus pumilus
  misc_feature (5)..(5): n is a, c, g, or t
  misc_feature (9)..(9): n is a, c, g, or t
  misc_feature (715)..(715): n is a, c, g, or t
  misc_feature (718)..(733): n is a, c, g, or t
  misc_feature (735)..(735): n is a, c, g, or t
  misc_feature (739)..(741): n is a, c, g, or t
  misc_feature (743)..(744): n is a, c, g, or t
  misc_feature (747)..(747): n is a, c, g, or t
  misc_feature (753)..(754): n is a, c, g, or t
  misc_feature (756)..(757): n is a, c, g, or t
  misc_feature (767)..(768): n is a, c, g, or t
  misc_feature (770)..(770): n is a, c, g, or t
  misc_feature (775)..(775): n is a, c, g, or t
  misc_feature (779)..(784): n is a, c, g, or t
  misc_feature (787)..(788): n is a, c, g, or t
  misc_feature (791)..(792): n is a, c, g, or t
  misc_feature (794)..(794): n is a, c, g, or t
  misc_feature (799)..(800): n is a, c, g, or t
  misc_feature (802)..(802): n is a, c, g, or t
  misc_feature (807)..(807): n is a, c, g, or t
  misc_feature (809)..(810): n is a, c, g, or t
  misc_feature (815)..(815): n is a, c, g, or t
  misc_feature (818)..(818): n is a, c, g, or t
  misc_feature (826)..(826): n is a, c, g, or t
  misc_feature (829)..(831): n is a, c, g, or t
  misc_feature (835)..(835): n is a, c, g, or t
  misc_feature (838)..(841): n is a, c, g, or t
  misc_feature (846)..(848): n is a, c, g, or t
ctganggancacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgnacnnnnnnnnnnnnnnnncntctnnnanncgngctgannannccatgcaccnncngtcantctnnnnnnggnnaanncntattnntngggtngnncagangangtcagacnggnnnggtnctnnnnttgcnnnat

SEQ ID NO: 234 - DNA, 996 bp, Bacillus thuringiensis
atgaatttagctaaattcccgagaaaaaaatatacagaatcatatacaccaattgaaaagttaaacaacttttctgaagcacttggtgggccgactatttattttaaacgagatgatttacttggtttaacagctggtggtaataagacgagaaagttagagtttctagttgcggatgcagaggcaaaaggtgcagatacgttaattacagctggtggtattcagtcaaaccattgccgtctaacactggcagctgcggtaaaagaaaaaatgaaatgtatccttgtattagaagaagggcttgaaccagaagagaagccagactttaacggaaactatttcttatatcatttactaggtgctgaaaatgtaattgttgtaccaaacggggcagatcttatggaagagatgcataaagtagcgaaagaagttagtgaaaaaggtaatacaccatatgtcataccagttggtggatcaaatcctactggtgcaatgggatacgttgcttgtgcgcaagaaattatggcacaatcatttgaccaaggaattgatttcagtacagtcgtttgcgtaagcggtagcgctggtatgcacgctggtttaattactggttttgctggaacacaaagccacattcctgtaattggaatcaacgtaagtagaggaaaagctgagcaagaagagaaagtagcaaaacttgtagatgaaacttcagcacacgttggtattccaaactttatcccgcgtgacgctgttacgtgctttgatgaatatgtagggccaggatatgcgttaccaacgccggaaatggtagaggcagttcagttacttgcgaaaacagaaggtattttacttgatccagtgtatacaggtaaagcggtagcgggattaatcgacttaattaaaaaaggtacatttaataaagaagacaacattttattcgtacattcaggtggttcaccagctttatatgcgaatacttctttatttgcgtaa

SEQ ID NO: 235 - DNA, 996 bp, Bacillus pseudomycoides
atgaatttagcgaagtttcctagaaagaaatacacagaatcatatacgccaatcgaaaaattaaatcacttttctgaagtcctaggaggaccttctatttactttaaacgagatgatttacttggtttaacagctggcggaaataaaacaagaaaattagaattccttgtggcggatgcacaggcgaaaggtgtagatacgttaattactgctggtggtattcagtcaaatcattgccgattaacattagcggctgcggtaaaagagaaaatgaaatgcattcttgtattagaagaaggacttgaaccagaagaaaaaccagactttaatgggaattacttcttatatcatttattaggtgctgaaaatgtaatcgttgtgccaaacggaactgaccttatggatgagatgcaaaaagtggccaaagaagtaactgaaaaagggcatacaccatacgtcattccagttggaggatccaatcctaccggtgcaatgggatatattgcatgtgcagaggaaattatggctcaatcgtttgagcaagggatagatttcaatgcggttgtttgtgtaagtggtagcggtggcatgcatgctggtttgattactggattttatggaagacaaacagggatcccgataatcggaatgaatgtgagccgcggaaaagctgaacaagaagaaaaagtatgtaagcttgtgcaagaaacttcagcgcatgttggtattccaaacagtattccgcgtgaggctgtgacatgttttgatgaatacgttgggccaggatacgctttaccaacacctgaaatggtagaagctgttcaacttttagcaaaaacagaaggaattttactggatccagtatatacagggaaagcagtagctggactgatcgacataattcgaaaaggtacatttaagaaagaagataacatcctatttgtacattcaggtggttctccggcgttatatgcgaatacatcactattttcctaa

SEQ ID NO: 236 - DNA, 996 bp, Bacillus thuringiensis
atgaatttagctaaattcccgagaaaaaaatatacagagtcatatacaccaattgaaaaattaaacaatttttctgaagtacttggtgggccgactatttattttaaacgagatgatttacttggtttaacagctggtggtaataagacgagaaagttagagtttctagttgcggatgcacaggcaaaaggtgcagatacgttaattacagctggtggtattcagtcaaaccattgccgtctaacactggcagctgcggtaaaagaaaaaatgaaatgtatccttgtattagaagaagggcttgaaccagaagagaagccagactttaacggaaactatttcttatatcacttattaggtgctgaaaatgtcattgttgtaccaaacggagcagacctgatggaagaaatgcataaagtagcaaaagaagtaagtgaaaaagggaatacaccatatgtaattccagttggtggatcaaaccctacgggcgctatgggatacgttgcttgtgcgcaagaaattatggcgcaatcatttgagcaaggaattgatttcagttcagttgtttgtgtaagtggtagcggcggtatgcatgctggtttaattactggttttgctggaacacaaagccacattcctgtaattggaatcaacgtaagtagaggaaaagctgagcaagaagagaaagtagcaaaacttgtagatgaaacttcagcacacgttggtattccaaactttatctcgcgcgacgctgttacgtgctttgatcaatatgtaggaccaggctatgcgttaccaacgcaggaaatggtagaggcagttcagttacttgcgaaaacagaaggtattttacttgatccagtgtatacaggtaaagcggtagcgggattaatcgacttaattaaaaaagggacatttaataaagaagacaacattttattcgtacattcaggtggttcaccagctttatatgcgaatacttctttatttgcgtaa

SEQ ID NO: 237 - DNA, 996 bp, Bacillus thuringiensis
atgaatttagctaaattcccgagaaaaaaatatacagaatcatatacaccaattgaaaagttaaacaatttttctgaagcacttggtggcccgactatttattttaaacgagatgatttacttggtttaacagccggtggtaataagacgagaaagttagaatttttagttgcggatgcacaggaaaagggtgcagatacgttaattacagctggtggtattcagtcaaatcattgccgcctgacacttgctgctgcggtaaaagaaaaaatgaaatgtattcttgtattagaggaagggcttgagccagaagagaagagagactttaacggaaactatttcttatatcacttattaggtgctgaaaacgtcattgttgtaccgaacggagcagacctgatggaagagatgaataaagtagcgaaagaagtaagtgaaaaaggtagtacaccatatgtaattccagttggtggatcaaaccctacgggcgcaatgggatacgttgcttgtgcgcaagaaattatggcgcaatcatttgagcaaggaattgatttcagttcagttgtttgtgtaagtggtagcggcggtatgcatgctggtttaattactggtttttctggaacacaaagccatattcctgtaatcgggattaatgtaagtagaggaaaagctgagcaagaagagaaagtagcaaaacttgtagatgaaacttcagcacacgttggtattccaaactttatctcgcgcgacgctgttacgtgctttgatgaatatgtaggaccaggctatgcgttaccaacgccggaaatggtagaggcagttcagttacttgcgaaaacagaaggtattttacttgatccagtgtatacaggtaaggcagtagcgggattaatcgacttaattagaaaaggtaaatttaataaggaagacaatattttattcgtacattcaggtggttcaccagctttatatgcgaatacttctttatttgcgtaa

SEQ ID NO: 238 - DNA, 996 bp, Bacillus thuringiensis
atgaatttagctaaattcccgagaaaaaaatatacagaatcatatacaccaattgaaaagttaaacaacttttctgaagcacttggtgggccgactatttattttaaacgagatgatttacttggtttaacagctggtggtaataagacgagaaagttagagtttctagttgcggatgcagaggcaaaaggtgcagatacgttaattacagctggtggtattcagtcaaaccattgccgtctaacactggcagctgcggtaaaagaaaaaatgaaatgtatccttgtattagaagaagggcttgaaccagaagagaagccagactttaacggaaactatttcttatatcatttactaggtgctgaaaatgtaattgttgtaccaaacggggcagatcttatggaagagatgcataaagtagcgaaagaagttagtgaaaaaggtaatacaccatatgtcataccagttggtggatcaaatcctactggtgcaatgggatacgttgcttgtgcgcaagaaattatggcacaatcatttgaccaaggaattgatttcagtacagtcgtttgcgtaagcggtagcgctggtatgcacgctggtttaattactggttttgctggaacacaaagccacattcctgtaattggaatcaacgtaagtagaggaaaagctgagcaagaagagaaagtagcaaaacttgtagatgaaacttcagcacacgttggtattccaaactttatcccgcgtgacgctgttacgtgctttgatgaatatgtagggccaggatatgcgttaccaacgccggaaatggtagaggcagttcagttacttgcgaaaacagaaggtattttacttgatccagtgtatgaaggtaaagcggtagcgggattaatcgacttaattaaaaaaggtacatttaataaagaagacaacattttattcgtacatttaggtggttcaccagctttatatgcgaatacttctttatttgcgtaa

SEQ ID NO: 239 - DNA, 996 bp, Bacillus pseudomycoides
atgaatttagcgaagtttcctagaaagaaatacacagaatcatatacgccaatcgaaaaattaaatcacttttctgaagtcctaggaggaccttctatttactttaaacgagatgatttacttggtttaacagctggcggaaataaaacaagaaaattagaattccttgtggcggatgcacaggcgaaaggtgtagatacgttaattactgctggtggtattcagtcaaatcattgccgattaacattagcggctgcggtaaaagagaaaatgaaatgcattcttgtattagaagaaggacttgaaccagaagaaaaaccagactttaatgggaattacttcttatatcatttattaggtgctgaaaatgtaatcgttgtgccaaacggaactgaccttatggatgagatgcaaaaagtggccaaagaagtaactgaaaaagggcatacaccatacgtcattccagttggaggatccaatcctaccggtgcaatgggatatattgcatgtgcagaggaaattatggctcaatcgtttgagcaagggatagatttcaatgcggttgtttgtgtaagtggtagcggtggcatgcatgctggtttgattactggattttatggaagacaaacagggatcccgataatcggaatgaatgtgagccgcggaaaagctgaacaagaagaaaaagtatgtaagcttgtgcaagaaacttcagcgcatgttggtattccaaacagtattccgcgtgaggctgtgacatgttttgatgaatacgttgggccaggatacgctttaccaacacctgaaatggtagaagctgttcaacttttagcaaaaacagaaggaattttactggatccagtatatgaagggaaagcagtagctggactgatcgacataattcgaaaaggtacatttaagaaagaagataacatcctatttgtacatttaggtggttctccggcgttatatgcgaatacatcactattttcctaa

SEQ ID NO: 240 - DNA, 996 bp, Bacillus thuringiensis
atgaatttagctaaattcccgagaaaaaaatatacagagtcatatacaccaattgaaaaattaaacaatttttctgaagtacttggtgggccgactatttattttaaacgagatgatttacttggtttaacagctggtggtaataagacgagaaagttagagtttctagttgcggatgcacaggcaaaaggtgcagatacgttaattacagctggtggtattcagtcaaaccattgccgtctaacactggcagctgcggtaaaagaaaaaatgaaatgtatccttgtattagaagaagggcttgaaccagaagagaagccagactttaacggaaactatttcttatatcacttattaggtgctgaaaatgtcattgttgtaccaaacggagcagacctgatggaagaaatgcataaagtagcaaaagaagtaagtgaaaaagggaatacaccatatgtaattccagttggtggatcaaaccctacgggcgctatgggatacgttgcttgtgcgcaagaaattatggcgcaatcatttgagcaaggaattgatttcagttcagttgtttgtgtaagtggtagcggcggtatgcatgctggtttaattactggttttgctggaacacaaagccacattcctgtaattggaatcaacgtaagtagaggaaaagctgagcaagaagagaaagtagcaaaacttgtagatgaaacttcagcacacgttggtattccaaactttatctcgcgcgacgctgttacgtgctttgatcaatatgtaggaccaggctatgcgttaccaacgcaggaaatggtagaggcagttcagttacttgcgaaaacagaaggtattttacttgatccagtgtatgaaggtaaagcggtagcgggattaatcgacttaattaaaaaagggacatttaataaagaagacaacattttattcgtacatttaggtggttcaccagctttatatgcgaatacttctttatttgcgtaa

SEQ ID NO: 241 - DNA, 996 bp, Bacillus thuringiensis
atgaatttagctaaattcccgagaaaaaaatatacagaatcatatacaccaattgaaaagttaaacaatttttctgaagcacttggtggcccgactatttattttaaacgagatgatttacttggtttaacagccggtggtaataagacgagaaagttagaatttttagttgcggatgcacaggaaaagggtgcagatacgttaattacagctggtggtattcagtcaaatcattgccgcctgacacttgctgctgcggtaaaagaaaaaatgaaatgtattcttgtattagaggaagggcttgagccagaagagaagagagactttaacggaaactatttcttatatcacttattaggtgctgaaaacgtcattgttgtaccgaacggagcagacctgatggaagagatgaataaagtagcgaaagaagtaagtgaaaaaggtagtacaccatatgtaattccagttggtggatcaaaccctacgggcgcaatgggatacgttgcttgtgcgcaagaaattatggcgcaatcatttgagcaaggaattgatttcagttcagttgtttgtgtaagtggtagcggcggtatgcatgctggtttaattactggtttttctggaacacaaagccatattcctgtaatcgggattaatgtaagtagaggaaaagctgagcaagaagagaaagtagcaaaacttgtagatgaaacttcagcacacgttggtattccaaactttatctcgcgcgacgctgttacgtgctttgatgaatatgtaggaccaggctatgcgttaccaacgccggaaatggtagaggcagttcagttacttgcgaaaacagaaggtattttacttgatccagtgtatgaaggtaaggcagtagcgggattaatcgacttaattagaaaaggtaaatttaataaggaagacaatattttattcgtacatttaggtggttcaccagctttatatgcgaatacttctttatttgcgtaa

SEQ ID NO: 242 - protein, 331 aa, Bacillus thuringiensis
MNLAKFPRKKYTESYTPIEKLNNFSEALGGPTIYFKRDDLLGLTAGGNKTRKLEFLVADAEAKGADTLITAGGIQSNHCRLTLAAAVKEKMKCILVLEEGLEPEEKPDFNGNYFLYHLLGAENVIVVPNGADLMEEMHKVAKEVSEKGNTPYVIPVGGSNPTGAMGYVACAQEIMAQSFDQGIDFSTVVCVSGSAGMHAGLITGFAGTQSHIPVIGINVSRGKAEQEEKVAKLVDETSAHVGIPNFIPRDAVTCFDEYVGPGYALPTPEMVEAVQLLAKTEGILLDPVYTGKAVAGLIDLIKKGTFNKEDNILFVHSGGSPALYANTSLFA

SEQ ID NO: 243 - protein, 331 aa, Bacillus pseudomycoides
MNLAKFPRKKYTESYTPIEKLNHFSEVLGGPSIYFKRDDLLGLTAGGNKTRKLEFLVADAQAKGVDTLITAGGIQSNHCRLTLAAAVKEKMKCILVLEEGLEPEEKPDFNGNYFLYHLLGAENVIVVPNGTDLMDEMQKVAKEVTEKGHTPYVIPVGGSNPTGAMGYIACAEEIMAQSFEQGIDFNAVVCVSGSGGMHAGLITGFYGRQTGIPIIGMNVSRGKAEQEEKVCKLVQETSAHVGIPNSIPREAVTCFDEYVGPGYALPTPEMVEAVQLLAKTEGILLDPVYTGKAVAGLIDIIRKGTFKKEDNILFVHSGGSPALYANTSLFS

SEQ ID NO: 244 - protein, 331 aa, Bacillus thuringiensis
MNLAKFPRKKYTESYTPIEKLNNFSEVLGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFAGTQSHIPVIGINVSRGKAEQEEKVAKLVDETSAHVGIPNFISRDAVTCFDQYVGPGYALPTQEMVEAVQLLAKTEGILLDPVYTGKAVAGLIDLIKKGTFNKEDNILFVHSGGSPALYANTSLFA

SEQ ID NO: 245 - protein, 331 aa, Bacillus thuringiensis
MNLAKFPRKKYTESYTPIEKLNNFSEALGGPTIYFKRDDLLGLTAGGNKTRKLEFLVADAQEKGADTLITAGGIQSNHCRLTLAAAVKEKMKCILVLEEGLEPEEKRDFNGNYFLYHLLGAENVIVVPNGADLMEEMNKVAKEVSEKGSTPYVIPVGGSNPTGAMGYVACAQEIMAQSFEQGIDFSSVVCVSGSGGMHAGLITGFSGTQSHIPVIGINVSRGKAEQEEKVAKLVDETSAHVGIPNFISRDAVTCFDEYVGPGYALPTPEMVEAVQLLAKTEGILLDPVYTGKAVAGLIDLIRKGKFNKEDNILFVHSGGSPALYANTSLFA

SEQ ID NO: 246 - protein, 331 aa, Bacillus thuringiensis
MNLAKFPRKKYTESYTPIEKLNNFSEALGGPTIYFKRDDLLGLTAGGNKTRKLEFLVADAEAKGADTLITAGGIQSNHCRLTLAAAVKEKMKCILVLEEGLEPEEKPDFNGNYFLYHLLGAENVIVVPNGADLMEEMHKVAKEVSEKGNTPYVIPVGGSNPTGAMGYVACAQEIMAQSFDQGIDFSTVVCVSGSAGMHAGLITGFAGTQSHIPVIGINVSRGKAEQEEKVAKLVDETSAHVGIPNFIPRDAVTCFDEYVGPGYALPTPEMVEAVQLLAKTEGILLDPVYEGKAVAGLIDLIKKGTFNKEDNILFVHLGGSPALYANTSLFA

SEQ ID NO: 247 - protein, 331 aa, Bacillus pseudomycoides
MNLAKFPRKKYTESYTPIEKLNHFSEVLGGPSIYFKRDDLLGLTAGGNKTRKLEFLVADAQAKGVDTLITAGGIQSNHCRLTLAAAVKEKMKCILVLEEGLEPEEKPDFNGNYFLYHLLGAENVIVVPNGTDLMDEMQKVAKEVTEKGHTPYVIPVGGSNPTGAMGYIACAEEIMAQSFEQGIDFNAVVCVSGSGGMHAGLITGFYGRQTGIPIIGMNVSRGKAEQEEKVCKLVQETSAHVGIPNSIPREAVTCFDEYVGPGYALPTPEMVEAVQLLAKTEGILLDPVYEGKAVAGLIDIIRKGTFKKEDNILFVHLGGSPALYANTSLFS

SEQ ID NO: 248 - protein, 331 aa, Bacillus thuringiensis
MNLAKFPRKKYTESYTPIEKLNNFSEVLGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFAGTQSHIPVIGINVSRGKAEQEEKVAKLVDETSAHVGIPNFISRDAVTCFDQYVGPGYALPTQEMVEAVQLLAKTEGILLDPVYEGKAVAGLIDLIKKGTFNKEDNILFVHLGGSPALYANTSLFA

SEQ ID NO: 249 - protein, 331 aa, Bacillus thuringiensis
MNLAKFPRKKYTESYTPIEKLNNFSEALGGPTIYFKRDDLLGLTAGGNKTRKLEFLVADAQEKGADTLITAGGIQSNHCRLTLAAAVKEKMKCILVLEEGLEPEEKRDFNGNYFLYHLLGAENVIVVPNGADLMEEMNKVAKEVSEKGSTPYVIPVGGSNPTGAMGYVACAQEIMAQSFEQGIDFSSVVCVSGSGGMHAGLITGFSGTQSHIPVIGINVSRGKAEQEEKVAKLVDETSAHVGIPNFISRDAVTCFDEYVGPGYALPTPEMVEAVQLLAKTEGILLDPVYEGKAVAGLIDLIRKGKFNKEDNILFVHLGGSPALYANTSLFA

SEQ ID NO: 250 - protein, 259 aa, Bacillus thuringiensis
HENDGGQRFGVIPRWSAEDKHKEGVNSHLWIVNRAIDIMSRNTTLVKQDRVALLNEWRTELENGIYAADYENPYYDNSTFASHFYDPDNGKTYIPYAKQAKETGAKYFKLAGESYKNKDMQQAFFYLGLSLHYLGDVNQPMHAANFTNLSYPQGFHSKYENFVDTIKDNYKVTDGNGYWNWKGTNPEDWIHGAAVVAKQDYAGIVNDNTKDWFVRAAVSQEYADKWRAEVTPMTGKRLMDAQRVTAGYIQLWFDTYGDR

SEQ ID NO: 251 - protein, 244 aa, Bacillus thuringiensis
SAEDKHKEGVNSHLWIVNRAIDIMSRNTTLVKQDRVALLNEWRTELENGIYAADYENPYYDNSTFASHFYDPDNGKTYIPYAKQAKETGAKYFKLAGESYKNKDMQQAFFYLGLSLHYLGDVNQPMHAANFTNLSYPQGFHSKYENFVDTIKDNYKVTDGNGYWNWKGTNPEDWIHGAAVVAKQDYAGIVNDNTKDWFVRAAVSQEYADKWRAEVTPMTGKRLMDAQRVTAGYIQLWFDTYGDR

SEQ ID NO: 252 - protein, 259 aa, Bacillus thuringiensis
HENDGGQRFGVIPRWSAEDKHKEGVNSHLWIVNRAIDIMSRNTTLVKQDRVALLNEWRTELENGIYAADYENPYYDNSTFASHFYDPDNGKTYIPYAKQAKETGAKYFKLAGESYKNKDMKQAFFYLGLSLHYLGDVNQPMHAANFTNLSYPQGFHSKYENFVDTIKDNYKVTDGNGYWNWKGTNPEDWIHGAAVVAKQDYAGIVNDNTKDWFVRAAVSQEYADKWRAEVTPMTGKRLMDAQRVTAGYIQLWFDTYGNR

SEQ ID NO: 253 - protein, 305 aa, Bacillus thuringiensis
ASTNQNDTLKVMTHNVYMLSTNLYPNWGQTERADLIGAADYIKNQDVVILNEVFDNSASDRLLGNLKKEYPNQTAVLGRSSGSEWDKKLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYTSMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 254 - protein, 259 aa, Bacillus cereus
HENDGGSKIKIVHRWSAEDKHKEGVNSHLWIVNRAIDIMSRNTTLVKQDRVAQLNEWRTELENGIYAADYENPYYDNSTFASHFYDPDNGKTYIPFAKQAKETGAKYFKLAGESYKNKDMKQAFFYLGLSLHYLGDVNQPMHAANFTNLSYPQGFHSKYENFVDTIKDNYKVTDGNGYWNWKGTNPEEWIHGAAVVAKQDYSGIVNDNTKDWFVKAAVSQEYADKWRAEVTPMTGKRLMDAQRVTAGYIQLWFDTYGDR

SEQ ID NO: 255 - protein, 369 aa, Clostridium perfringens
DGKIDGTGTHAMIVTQGVSILENDLSKNEPESVRKNLEILKENMHELQLGSTYPDYDKNAYDLYQDHFWDPDTDNNFSKDNSWYLAYSIPDTGESQIRKFSALARYEWQRGNYKQATFYLGEAMHYFGDIDTPYHPANVTAVDSAGHVKFETFAEERKEQYKINTAGCKTNEDFYADILKNKDFNAWSKEYARGFAKTGKSIYYSHASMSHSWDDWDYAAKVTLANSQKGTAGYIYRFLHDVSEGNDPSVGKNVKELVAYISTSGEKDAGTDDYMYFGIKTKDGKTQEWEMDNPGNDFMTGSKDTYTFKLKDENLKIDDIQNMWIRKRKYTAFPDAYKPENIKIIANGKVVVDKDINEWISGNSTYNIK

SEQ ID NO: 256 - protein, 510 aa, Streptomyces chromofuscus
TTGTPAFLHGVASGDPLPDGVLLWTRVTPTADATPGSGLGPDTEVGWTVATDKAFTNVVAKGSTTATAASDHTVKADIRGLAPATDHWFRFSAGGTDSPAGRARTAPAADAAVAGLRFGVVSCANWEAGYFAAYRHLAARGDLDAWLHLGDYIYEYGAGEYGTRGTSVRSHAPAHEILTLADYRVRHGRYKTDPDLQALHAAAPVVAIWDDHEIANDTWSGGAENHTEGVEGAWAARQAAAKQAYFEWMPVRPAIAGTTYRRLRFGKLADLSLLDLRSFRAQQVSLGDGDVDDPDRTLTGRAQLDWLKAGLKSSDTTWRLVGNSVMIAPFAIGSLSAELLKPLAKLLGLPQEGLAVNTDQWDGYTDDRRELLAHLRSNAIRNTVFLTGDIHMAWANDVPVNAGTYPLSASAATEFVVTSVTSDNLDDLVKVPEGTVSALASPVIRAANRHVHWVDTDRHGYGVLDITAERAQMDYYVLSDRTQAGATASWSRSYRTRSGTQRVERTYDPE

SEQ ID NO: 257 - protein, 259 aa, Bacillus cereus
HENDGGSKIKIVHRWSAEDKHKEGVNSHLWIVNRAIDIMSRNKTLVKQDRVALLNEWRTELENGIYAADYENPYYDNSTFASHFYDPDNGKTYIPYAKQAKETGAKYFKLAGESYKNKDMKQAFFYLGLSLHYLGDVNQPMHAANFTNLSYPQGFHSKYENFVDTIKDNYKVTDGNGYWNWKGTNPEDWIHGAAVVAKQDYAGIVNDNTKDWFVRAAVSQEYADKWRAEVTPMTGKRLMDAQRVTAGYIQLWFDTYGDR

SEQ ID NO: 258 - protein, 326 aa, Bacillus cereus
MRNKKLILKLFICSTIFITFVFALHDKRVVAASSVNELENWSKWMQPIPDNIPLARISIPGTHDSGTFKLQNPIKQVWGMTQEYDFRYQMDHGARIFDIRGRLTDDNTIVLHHGPLYLYVTLHEFINEAKQFLKDNPSETIIMSLKKEYEDMKGAENSFSSTFEKNYFVDPIFLKTEGNIKLGDARGKIVLLKRYSGSNESGGYNNFYWPDNETFTTTVNKNVNVTVQDKYKVSYDEKVKSIKDTINETMNNSEDLNHLYINFTSLSSGGTAWNSPYYYASYINPEIAAYIKQENPKRVGWVIQDYISDKWSPILYQEVIRTNKSL

SEQ ID NO: 259 - protein, 407 aa, Acidovorax avenae
MSGGHRVALLQGSAELFSALVADMDAALSDIQFETYIFDCTGSGADIAEALIRAARRGVRVHLVVDGVGTGRLCSPWPERFEEAGVRMQVYSPLGPLGLLLPRRWRRLHRKLCVVDGCVLYCGGINVLDDLHDPNHGALESPRFDFAVRVEGRLVEEAGEAMEQVWWRLQATRDARQRRLADLMCDLRAAAQARQAERLAREAAPGGAAAAHGLRAGLLLRDNLRNRSRIERAYRRAIGNARHEVIIANAYFLPGRKLRHALVLAARRGVRVRLLLQGRYEYFMQYHAARPVYGALLAAGVEIHEYAPSFLHAKVAVIDAQGEHPWATVGSSNLDPLSMLLAREANVVVEDAGFARALRARLVDAMEHAGRQLDPQAYGARPWGQRLRDRVAFALMRLALWVTGSRY

SEQ ID NO: 260 - protein, 396 aa, Bacillus licheniformis
MVPLMIMVCFLILLLALDFHFGRKAFEKKAYEPVFSEKKSDIELIHNGEDLCERLLDDIRQAESSVHVMFYIVKNDDISLEFLKVLKDKAKSGVCVRLLIDRIGAMKVKKKTLSGLKQSGVHVFFANKPGFPYFFYRLNARNHRKIAVIDGKIGYVGGFNIAKEYLGKKAEFGPWKDYHLRMTGEGVADLQHIFISDFKREAPQAKPANSVFPPLQQGAVTHTTHATKGFSLEEKYISFIEQAKERIMICTPYYIPSPALQQAVLSARERGVIVSVLVPMKPDHPLVKEAAYTHFPALLKAGCYIYRYYRGFYHAKALIVDDRHVMIGTSNFDNRSLFLNDEVNVVIHDKDWTKQFFDVVKESIEHAELLTKERYAKRPVMQRPVEWLAKSISFFL

SEQ ID NO: 261 - protein, 15 aa, Bacillus thuringiensis
HENDGGQRFGVIPRW

SEQ ID NO: 262 - protein, 240 aa, Bacillus thuringiensis
MRTPLSFDKDTAILLASCCELTYEQYKQNGIFEIPDGFQYVQGFQGKAIQTTEWFGFILESEDTIIVAFRGTQTDPDWIIDSLVNQKPYPYALNGGNVHNGFLSIYESCRDSIMDMLVSLPAHKKLLATGHSLGGALATLHILDARINTAFAQYGLYSFASPKVGDIAFRNYYKLQVASSFRFVNLFDVVPLLPPRNINFNDHDWEYAHVHHNMTFTKNTKSITNNHSITTYKTCLTSHF

SEQ ID NO: 263 - protein, 181 aa, Bacillus subtilis
AEHNPVVMVHGIGGASFNFAGIKSYLVSQGWSRDKLYAVDFWDKTGTNYNNGPVLSRFVQKVLDETGAKKVDIVAHSMGGANTLYYIKNLDGGNKVANVVTLGGANRLTTGKALPGTDPNQKILYTSIYSSADMIVMNYLSRLDGARNVQIHGVGHIGLLYSSQVNSLIKEGLNGGGQNTN

SEQ ID NO: 264 - protein, 320 aa, Burkholderia cepacia
AAGYAATRYPIILVHGLSGTDKYAGVLEYWYGIQEDLQQNGATVYVANLSGFQSDDGPNGRGEQLLAYVKTVLAATGATKVNLVGHSQGGLSSRYVAAVAPDLVASVTTIGTPHRGSEFADFVQDVLAYDPTGLSSSVIAAFVNVFGILTSSSHNTNQDALAALQTLTTARAATYNQNYPSAGLGAPGSCQTGAPTETVGGNTHLLYSWAGTAIQPTLSVFGVTGATDTSTLPLVDPANVLDLSTLALFGTGTVMINRGSGQNDGLVSKCSALYGKVLSTSYKWNHLDEINQLLGVRGAYAEDPVAVIRTHANRLKLAGV

SEQ ID NO: 265 - protein, 453 aa, Pseudomonas fluorescens
ITLYSYHNLDNGFAVGYQHNGLGLGLPATLVGALLGSTDSQGVIPGIPWNPDSEKAALEAVQKAGWTPISASALGYAGKVDARGTFFGEKAGYTTAQVEVLGKYDDAGKLLEIGIGFRGTSGPRETLISDSIGDLISDLLAALGPKDYAKNYAGEAFGGLLKNVADYAGAHGLTGKDVVVSGHSLGGLAVNSMADLSNYKWAGFYKDANYVAYASPTQSAGDKVLNIGYENDPVFRALDGSSFNLSSLGVHDKPHESTTDNIVSFNDHYASTLWNVLPFSIVNLPTWVSHLPTAYGDGMTRILESGFYDQMTRDSTVIVANLSDPARANTWVQDLNRNAEPHKGNTFIIGSDGNDLIQGGNGADFIEGGKGNDTIRDNSGHNTFLFSGHFGNDRVIGYQPTDKLVFKDVQGSTDLRDHAKVVGADTVLTFGADSVTLVGVGHGGLWTEGVVIG

SEQ ID NO: 266 - protein, 355 aa, Burkholderia stearothermophilus
MDKLIVDDLHLSYGANPILKGVSFELKAGEVVCLLGASGSGKTTLLRAVAGLEQPSDGRIQLDDRVFFDGAKRVDLPVEQRSLGLVFQSYALWPHRTVADNVGYGLKLRRVAPAEQKRRVQSALDQLGLGHLAERFPHQLSGGQQQRVAIARALVYNPPVILLDEPLSNLDAKLREEARAWLRELIVSLGLSALCVTHDQTEAMAMSDRILLLRNGRIEQEGTPAELYGAPRSLYTAEFMGSNNRIDARVAAIDGECVTLAGDGWEIRAMARDTLAPGQDAQAVIRLERVQVTDGPGANRLQADLVTSMYLGDRWEYLFHCGDMRLRAFGHVPRAAGKHWIEFPTNDCWAFAKAG

SEQ ID NO: 267 - protein, 309 aa, Caldicellulosiruptor saccharolyticus
KDLEGVHRDILLKHFNSLTPENAMKFENIHPEEQRYNFEEVARIKEFAIKNDMKLRGHTFVWHNQTPGWVFLDKNGEEASKELVIERLREHIKTLCERYKDVVYAWDVVNEAVEDKTEKLLRESNWRKIIGDDYIKIAFEIAREYAGDAKLFYNDYNNEMPYKLEKTYKVLKELLERGTPIDGIGIQAHWNIWDKNLVSNLKKAIEVYASLGLEIHITELDISVFEFEDKRTDLFEPTPEMLELQAKVYEDVFAVFREYKDVITSVTLWGISDRHTWKDNFPVKGRKDWPLLFDVNGKPKEALYRILRF

SEQ ID NO: 268 - protein, 185 aa, Bacillus subtilis
ASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQSKRPTGSNATITFSNHVNAWKSHGMNLGSNWAYQVMATEGYQSSGSSNVTVW

SEQ ID NO: 269 - protein, 487 aa, Bacillus subtilis
ATSTTIAKHIGNSNPLIDHHLGADPVALTYNGRVYIYMSSDDYEYNSNGTIKDNSFANLNRVFVISSADMVNWTDHGAIPVAGANGANGGRGIAKWAGASWAPSIAVKKINGKDKFFLYFANSGGGIGVLTADSPIGPWTDPIGKPLVTPSTPGMSGVVWLFDPAVFVDDDGTGYLYAGGGVPGVSNPTQGQWANPKTARVIKLGPDMTSVVGSASTIDAPFMFEDSGLHKYNGTYYYSYCINFGGTHPADKPPGEIGYMTSSSPMGPFTYRGHFLKNPGAFFGGGGNNHHAVFNFKNEWYVVYHAQTVSSALFGAGKGYRSPHINKLVHNADGSIQEVAANYAGVTQISNLNPYNRVEAETFAWNGRILTEKSTAPGGPVNNQHVTSIQNGDWIAVGNADFGAGGARSFKANVASTLGGKIEVRLDSADGKLVGTLNVPSTGGAQTWREIETAVSGATGVHKVFFVFTGTGTGNLFNFDYWQFTQR

SEQ ID NO: 270 - protein, 183 aa, Geobacillus stearothermophilus
ATDYWQYWTDGGGMVNAVNGPGGNYSVTWQNTGNFVVGKGWTVGSPNRVINYNAGIWEPSGNGYLTLYGWTRNALIEYYVVDSWGTYRPTGNYKGTVNSDGGTYDIYTTMRYNAPSIDGTQTFQQFWSVRQSKRPTGSNVSITFSNHVNAWRSKGMNLGSSWAYQVLATEGYQSSGRSNVTVW

SEQ ID NO: 271 - protein, 258 aa, Thermomyces lanuginosus
MVGFTPVALAALAATGALAFPAGNATELEKRQTTPNSEGWHDGYYYSWWSDGGAQATYTNLEGGTYEISWGDGGNLVGGKGWNPGLNARAVRVPQDRNRIVIRPRSFESLKAFLTPTSLTCTQIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 272 - protein, 860 aa, Neocallimastix patriciarum
MKFSSANKILFSGLVASANAYDLLKDYAGDLKIGVAANAMRFSNSNYVNAMKAFNMMVAENDCKLSGIQQQKGVYNFNGCDNHYNKAKELGMEFRGHCLIWHSYQPSWFQNADANTLKNAIVDHITKTLQHYEGKIKVWDVVNEAIDDNSNGNGWNMRRSFLYNKVPNFVDLAFQTARKVSPNTKLFYNDYNAEGVYAKAESIYNFVSDLKKRNIPIDGVGLQYHVGAKEQPSYNKINDLIGRYCKLGLEVHITELDVKLQGDQNGQSQAFSNALKACLANSCCKAFLVWGVGDNDSWLGANEQALLFNGSYQPKPVYNTLLNILKTSARPASSSAKTLPGNSKSKTLPGVNSKTLPGNKSKTLPGASKTLPGNKSKTLPGGNSNTLPGNKSKTLPGGNSKTLPGNKSRTLPGGNSKTLPGGKSRTLPGGNSKTLPGGKSKTLPGGNSKTLPGGKSKTLPGGNSKTLPGGSSKTLPGGKSKTLPGGNSKTLPGGSSKTLPGGKSKTLPGGSSKTLPGGKSKTLPGGNSKTLPGGNSKTLPGGSSKTLPGGKSKTLPGGNSKTLPGGSSKTLPGGKSKTLPGGNSKTLPGGNSKTLPGGKSKTLPGGNSKTLPGGSSKTLPGGKSKTLPGGSSKTLPGGKSKTLPGGNSKTLPGGNSKTLPGGSSKTLPGGKSKTLPGGSSKTLPGGKSKTLPGGNSKTLPGGKSKTLPGGNSKTLPGGKSKTLPGGNSKTLPGGKSKTLPGGNSKTLPGGSSKTLPGGKSKTLPGGNSKTLPGGKSKTLPGGNTKTLPGGACKPTTVTVTQKVTVTVTVESQPTQGGMNQGGGNCAAKWGQCGGNGFNGPTCCQNGSRCQFVNEWYSQCL

SEQ ID NO: 273 - protein, 390 aa, Bacillus subtilis
ASDVTVNVSAEKQVIRGFGGMNHPAWAGDLTAAQRETAFGNGQNQLGFSILRIHVDENRNNWYKEVETAKSAVKHGAIVFASPWNPPSDMVETFNRNGDTSAKRLKYNKYAAYAQHLNDFVTFMKNNGVNLYAISVQNEPDYAHEWTWWTPQEILRFMRENAGSINARVIAPESFQYLKNLSDPILNDPQALANMDILGTHLYGTQVSQFPYPLFKQKGAGKDLWMTEVYYPNSDTNSADRWPEALDVSQHIHNAMVEGDFQAYVWWYIRRSYGPMKEDGTISKRGYNMAHFSKFVRPGYVRIDATKNPNANVYVSAYKGDNKVVIVAINKSNTGVNQNFVLQNGSASNVSRWITSSSSNLQPGTNLTVSGNHFWAHLPAQSVTTFVVNR

SEQ ID NO: 274 - protein, 488 aa, Caldicellulosiruptor saccharolyticus
MERRKIMKITINYGKRLGKINKFWAKCVGSCHATTALREDWRKQLKKCRDELGFEYIRFHGWLNDDMSVCFRNDDGLLSFSFFNIDSIIDFLLEIGMKPFIELSFMPEALASGTKTVFHYKGNITPPKSYEEWGQLIEELARHLISRYGKNEVREWFFEVWNEPNLKDFFWAGTMEEYFKLYKYAAFAIKKVDSELRVGGPATAIDAWIPELKDFCTKNGVPIDFISTHQYPTDLAFSTSSNMEEAMAKAKRGELAERVKKALEEAYPLPVYYTEWNNSPSPRDPYHDIPYDAAFIVKTIIDIIDLPLGCYSYWTFTDIFEECGQSSLPFHGGFGLLNIHGIPKPSYRAFQILDKLNGERIEIEFEDKSPTIDCIAVQNEREIILVISNHNVPLSPIDTENIKVVLKGIENCREVFVERIDEYNANPKRVWLEMGSPAYLNREQIEELIKASELKKEKVSWGIVNNNEITFDLSVLPHSVVAVTIKNG

SEQ ID NO: 275 - protein, 535 aa, Bacillus pumilus
MKITNPVLKGFNPDPSICRAGEDYYMAVSTFEWFPGVQIYHSKDLIHWRLAARPLQKTSQLDMKGNPDSGGVWAPCLSYADGQFWLIYSDIKVVDGPFKDGHNYLVTADAVDGEWSDPVRLNSSGFDPSLFHDPSGKKYVLNMLWDHREKHHSFAGIALQEYSVSEKKLVGERKVIFKGTPIKLTEAPHLYYINDVYYLLTAEGGTRYEHAATIARSSRIDGPYEVHPDNPILTAFHAPSHPLQKCGHASIVQTHTNEWYLAHLTGRPIHSSKESIFQQRGWCPLGRETAIQKLEWKDGWPYVVGGKEGLLEVEAPAMSVKEFSPTYHIVDEFKDSSLNRHFQTLRIPFTDQIGSVTENPHHLRLYGQESLTSKFTQAFVARRWQSFYFEAETAVSFFPKNFQQAAGLVNYYNTENWTALQVTYDDALGRILELSVCENLAFSQPLIKKIIIPDEIPYVYLKVTVQRETYTYSYSFDQQEWEKIDVPLESTHLSDDFIRGGGFFTGAFVGMQCQDTSGERLPADFKYFRYEETTE

SEQ ID NO: 276 - protein, 533 aa, Bacillus subtilis
MKITNPVLKGFNPDPSICRAGEDYYIAVSTFEWFPGVQIHHSKDLVNWHLVAHPLQRVSQLDMKGNPNSGGVWAPCLSYSDGKFWLIYTDVKVVDGAWKDCHNYLVTCETINGDWSEPIKLNSSGFDASLFHDTDGKKYLLNMLWDHRIDRHSFGGIVIQEYSDKEQKLIGKPKVIFEGTDRKLTEAPHLYHIGNYYYLLTAEGGTRYEHAATIARSANIEGPYEVHPDNPILTSWHDPGNPLQKCGHASIVQTHTDEWYLAHLTGRPIHPDDDSIFQQRGYCPLGRETAIQKLYWKDEWPYVVGGKEGSLEVDAPSIPETIFEATYPEVDEFEDSTLNINFQTLRIPFTNELGSLTQAPNHLRLFGHESLTSTFTQAFVARRWQSLHFEAETAVEFYPENFQQAAGLVNYYNTENWTALQVTHDEELGRILELTICDNFSFSQPLNNKIVIPREVKYVYLRVNIEKDKYYYFYSFNKEDWHKIDIALESKKLSDDYIRGGGFFTGAFVGMQCQDTSGNHIPADFRYFRYKEK

SEQ ID NO: 277 - protein, 250 aa, Bacillus thuringiensis
MTVKKLYFIPAGRCMLDHSSVNSTLTPGNLLNLPVWCYLLETEEGPILVDTGMPEIAVNNEGLFNGTFVEGQILPKMTEEDRIITILKRAGYEPDDLLYIISSHLHFDHAGGNGAFSNTPIIIQRAEYEAAQYREEYLKECILPHLNYKIIEGDYEVVPGVRLLYTPGHSPGHQSLLIETEKSGPILLTIDASYTKENFEDEVPFAGFDSELALSSIKRLKEVVAKEKPIIFFGHDIEQEKGCKVFPEYI

SEQ ID NO: 278 - protein, 250 aa, Bacillus pseudomycoides
MTVKKLYFLPAGRCMLDHSSINSTLTPGKLLDLPVWCYLLETTEGPILIDTGMPESAVDNENLFKGTFVEGQIFPKMKPDDSIVNILKRVGYAPEDLLCVISSHFHFDHAGGNGSFSHTPIIVQRTEYDAALHREEYLKECILPDLNYQIIEGDYEVMPGVQLLYTPGHSPGHQSIFVETEKSGPVLLTIDAAYTQENFEQGVPFAGFNSEMASQSINRLKEIVLDEKPIIFFGHDMEQEKRCKTFPEFL

SEQ ID NO: 279 - protein, 242 aa, Bacillus subtilis
AGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDHLYYQPAMKRSDNAGLKTALARAVMYDTVIQHGDGDDPDSFYALIKRTNKKAGGSPKDGIDEKKWLNKFLDVRYDDLMNPANHDTRDEWRESVARVDVLRSIAKENNYNLNGPIHVRSNEYGNFVIK

SEQ ID NO: 280 - protein, 238 aa, Streptomyces sp.
AGAGLDDPHKKEIAMELVSSAENSSLDWKAQYKYIEDIGDGRGYTGGIIGFCSGTGDMLELVQHYTDLEPGNILAKYLPALKKVNGSASHSGLGTPFTKDWATAAKDTVFQQAQNDERDRVYFDPAVSQAKADGLRALGQFAYYDAIVMHGPGNDPTSFGGIRKTAMKKARTPAQGGDETTYLNAFLDARKAAMLTEAAHDDTSRVDTEQRVFLKAGNLDLNPPLKWKTYGDPYVINS

SEQ ID NO: 281 - protein, 469 aa, Acidothermus cellulolyticus
MGTYPIRSVSGGVALAACAVLTMTTAAAATPIHDASSPHTIPPHARLYTPPPDKGAIKQITDLLKARDVRDARLIAEMISTPQAVWFTGGTPDQVRRDVHRVVTKAAAHHAIPVLVAYNIPFRDCSQYSAGGAVDTAAYEAWIDGFAAGIGDKRAIVLLEPDSLGIIPYNTDINGNAEWCKPDLSGTGLTPDEANQARYDQLNYAVDALEAHRNVSVYLDGTHSGWLGVGDIAQRLVRAGVQRAQGFFVNVSNYQTTERQIKYGTWISECIAFANDPEEGGWRLGHYSWCASQYYPANPNDFSTWVQTDQWYASNLGTAVPTTHFVIDTSRNGRGPNDMTAYAAAPYNQPASVISALQGGSWCNPPGRGLGLRPTVNTGVPLLDAYLWVKIPGESDGQCDAAGGARAWDYSAYTEPGWPTDPSQQALFDPLWGLYDPPAGQWFPQQALQLAQLAVPPLQPQWPVPPVHH

SEQ ID NO: 282 - protein, 459 aa, Trichoderma reesei
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 283 - protein, 418 aa, Trichoderma reesei
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTSSGNSWTDTSLVSSCLARK

SEQ ID NO: 284 - protein, 344 aa, Trichoderma reesei
MIQKLSNLLVTALAVATGVVGHGHINDIVINGVWYQAYDPTTFPYESNPPIVVGWTAADLDNGFVSPDAYQNPDIICHKNATNAKGHASVKAGDTILFQWVPVPWPHPGPIVDYLANCNGDCETVDKTTLEFFKIDGVGLLSGGDPGTWASDVLISNNNTWVVKIPDNLAPGNYVLRHEIIALHSAGQANGAQNYPQCFNIAVSGSGSLQPSGVLGTDLYHATDPGVLINIYTSPLNYIIPGPTVVSGLPTSVAQGSSAATATASATVPGGGSGPTSRTTTTARTTQASSRPSSTPPATTSAPAGGPTQTLYGQCGGSGYSGPTRCAPPATCSTLNPYYAQCLN

SEQ ID NO: 285 - protein, 242 aa, Trichoderma reesei
MKATLVLGSLIVGAVSAYKATTTRYYDGQEGACGCGSSSGAFPWQLGIGNGVYTAAGSQALFDTAGASWCGAGCGKCYQLTSTGQAPCSSCGTGGAAGQSIIVMVTNLCPNNGNAQWCPVVGGTNQYGYSYHFDIMAQNEIFGDNVVVDFEPIACPGQAASDWGTCLCVGQQETDPTPVLGNDTGSTPPGSSPPATSSSPPSGGGQQTLYGQCGGAGWTGPTTCQAPGTCKVQNQWYSQCLP

SEQ ID NO: 286 - protein, 249 aa, Trichoderma reesei
MKSCAILAALGCLAGSVLGHGQVQNFTINGQYNQGFILDYYYQKQNTGHFPNVAGWYAEDLDLGFISPDQYTTPDIVCHKNAAPGAISATAAAGSNIVFQWGPGVWPHPYGPIVTYVVECSGSCTTVNKNNLRWVKIQEAGINYNTQVWAQQDLINQGNKWTVKIPSSLRPGNYVFRHELLAAHGASSANGMQNYPQCVNIAVTGSGTKALPAGTPATQLYKPTDPGILFNPYTTITSYTIPGPALWQG

SEQ ID NO: 287 - protein, 234 aa, Trichoderma reesei
MKFLQVLPALIPAALAQTSCDQWATFTGNGYTVSNNLWGASAGSGFGCVTAVSLSGGASWHADWQWSGGQNNVKSYQNSQIAIPQKRTVNSISSMPTTASWSYSGSNIRANVAYDLFTAANPNHVTYSGDYELMIWLGKYGDIGPIGSSQGTVNVGGQSWTLYYGYNGAMQVYSFVAQTNTTNYSGDVKNFFNYLRDNKGYNAAGQYVLSYQFGTEPFTGSGTLNVASWTASIN

SEQ ID NO: 288 - protein, 513 aa, Trichoderma reesei
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNRGTTTTRRPATTTGSSPGPTQSHYGQCGGIGYSGPTVCASGTTCQVLNPYYSQCL

SEQ ID NO: 289 - protein, 471 aa, Trichoderma reesei
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 290 - protein, 744 aa, Trichoderma reesei
MRYRTAAALALATGPFARADSHSTSGASAEAVVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 291 - protein, 466 aa, Trichoderma reesei
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 292 - protein, 405 aa, Aspergillus oryzae
MLPLLLCIVPYCWSSRLDPRASSFDYNGEKVRGVNLGGWLVLEPWITPSIFDAAGAEAVDEWSLTKILGKEEAEARLSAHWKSFVSAGDFQRMADAGLNHVRIPIGYWALGPLEGDPYVDGQLEYLDKAVEWAGAAGLKVLIDLHGAPGSQNGFDNSGRRGAIQWQQGDTVEQTLDAFDLLAERYLGSDTVAAIEAINEPNIPGGVDQGKLQEYYGSVYGIVNKYNAGTSVVYGDGFLPVESWNGFKTEGSKVVMDTHHYHMFDNGLIAMDIDSHIDAVCQFAHQHLEASDKPVIVGEWTGAVTDCAKYLNGKGNGARYDGSYAADKAIGDCSSLATGFVSKLSDEERSDMRRFIEAQLDAFELKSGWVFWTWKTEGAPGWDMSDLLEAGVFPTSPDDREFPKQC

SEQ ID NO: 293 - protein, 470 aa, Bacillus subtilis
AGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 294 - protein, 303 aa, Bacillus subtilis
AGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGT

SEQ ID NO: 295 - protein, 214 aa, Bacillus subtilis
QTGGSFFDPFNGYNSGFWQKADGYSNGNMFNCTWRANNVSMTSLGEMRLALTSPAYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTPGKIMMNLWNGTGVDEWLGSYNGVNPLYAHYDWVRYTKK

SEQ ID NO: 296 - protein, 307 aa, Clostridium thermocellum
EAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDQSVADVNRDGRIDSTDLTMLKRYLIRAIPSL

SEQ ID NO: 297 - protein, 839 aa, Bacillus circulans
AETAGTTITSMSYFSTADGPIITKSGVGQASYGFVMPIFNGGSATWNDVAQDLGVKVKVNGSWVDIDSVSSFVYNQNWGHWNDGGFTGYWFTLSATTEIQLYSKANEVTLEYSLVFQNINKTTITAMTPTQGPQITAGFTGGAGFTYPIFNHDPAITYAAVADDLKVYVKPVNSSQWIDIDNNAASGWIYDQNFGQFTDGGGGYWFNVTESINVKLESKTSSTNIVYTISFNEPVRNSYVLTPYEGTTFTADASGAIGIPLPKIDGGAPIGTELGNFVYQININGQWVDLDNSSQSGFVYSANGYNNMSAANQWGYWADHIYGLWFQPIQVDMQIRIGYPLNGQAGGSVGSNFVNYTLIGNPDAPRPDVNDQEDIPIGTPNDSAIEGMNLIWQDEFNGTALDQSKWNYETGYYLNDDPNTWGWGNSELQHYTDRAQNVFVQDGKLNIKALNEPKSFPQDPSRYAQYSSGKINTKDHFSLKYGRVDFRAKLPTGNGIWPALWMLPQDNVYGTWASSGEIDVMEAKGRLPGSTSGAVHFGGQWPTNRYLSGEYHFPEGQTFANDYHVYSVVWEEDNIKWYVDGKFFFKVTRDQWYSAAAPNNPNAPFDQPFYLIMNLAIGGTFDGGRTPDPSDIPATMQVDYVRVYKEGEGGGQNPGNVPVTGVTVNPTTAQVEVGQSVQLNASVAPSNATNKQVTWSVSGSSIASVSPNGLVTGLAQGTTTVTATTADGNKAASATITVAPAPSTVIVIGDEVKGLKKIGDDLLFYVNGATFADLHYKVNNGGQLNVAMAPTGNGNYTYPVHNLKHGDTVEYFFTYNPGQGALDTPWQTYVHGVTQGTPE

SEQ ID NO: 298 - protein, 644 aa, Bacillus circulans
AGTTVTSMEYFSPADGPVISKSGVGKASYGFVMPKFNGGSATWNDVYSDVGVNVKVGNNWVDIDQAGGYIYNQNWGHWSDGGFNGYWFTLSATTEIQLYSKANGVKLEYQLVFQNINKTTITAMNPTQGPQITASFTGGAGFTYPTFNNDSAVTYEAVADDLKVYVKPVNSSSWIDIDNNAASGWIYDHNFGQFTDGGGGYWFNVTESINVKLESKTSSANLVYTITFNEPTRNSYVITPYEGTTFTADANGSIGIPLPKIDGGAPIAKELGNFVYQININGQWVDLSNSSQSKFAYSANGYNNMSDANQWGYWADYIYGLWFQPIQENMQIRIGYPLNGQAGGNIGNNFVNYTFIGNPNAPRPDVSDQEDISIGTPTDPAIAGMNLIWQDEFNGTTLDTSKWNYETGYYLNNDPATWGWGNAELQHYTNSTQNVYVQDGKLNIKAMNDSKSFPQDPNRYAQYSSGKINTKDKLSLKYGRVDFRAKLPTGDGVWPALWMLPKDSVYGTWAASGEIDVMEARGRLPGSVSGTIHFGGQWPVNQSSGGDYHFPEGQTFANDYHVYSVVWEEDNIKWYVDGKFFYKVTNQQWYSTAAPNNPNAPFDEPFYLIMNLAVGGNFDGGRTPNASDIPATMQVDYVRVYKEQ

SEQ ID NO: 299 - protein, 363 aa, Paenibacillus pabuli
ADASQIVSEMGAGWNLGNQLEAAVNGTPNETAWGNPTVTPELIKKVKAAGFKSIRIPVSYLNNIGSAPNYTINAAWLNRIQQVVDYAYNEGLYVIINIHGDGYNSVQGGWLLVNGGNQTAIKEKYKKVWQQIATKFSNYNDRLIFESMNEVFDGNYGNPNSAYYTNLNAYNQIFVDTVRQTGGNNNARWLLVPGWNTNIDYTVGNYGFTLPTDNYRSSAIPSSQKRIMISAHYYSPWDFAGEENGNITQWGATSTNPAKKSTWGQEDYLESQFKSMYDKFVTQGYPVVIGEFGSIDKTSYDSSNNVYRAAYAKAVTAKAKKYKMVPVYWDNGHNGQHGFALFNRSNNTVTQQNIINAIMQGMQ

SEQ ID NO: 300 - protein, 232 aa, Bacillus licheniformis
ASSSNPSDKLYFKNKKYYIFNNVWGADQVSGWWQTIYHNSDSDMGWVWNWPSNTSTVKAYPSIVSGWHWTEGYTAGSGFPTRLSDQKNINTKVSYSISANGTYNAAYDIWLHNTNKASWDSAPTDEIMIWLNNTNAGPAGSYVETVSIGGHSWKVYKGYIDAGGGKGWNVFSFIRTANTQSANLNIRDFTNYLADSKQWLSKTKYVSSVEFGTEVFGGTGQINISNWDVTVR

SEQ ID NO: 301 - protein, 442 aa, Helix pomatia
MLSLVIALCVVGSLSAHLPEVFVHYQDGALHFKMQHVPGLKEVNFNYQLGSQAKNVIPKMGTANKGGDGYWHLTDKKIDLQPGDSIQYNAVAWGTAGKLHAPVASWVYAPEPTRGPRRLRGAVMFRDDFNGGGLDTNNWNYEVSMYGGMNWEFQVYTNDKSNVYTNNGKLFLKPTKTVDDPRWDENFLHSGVMDVAQIWGYCTQSAQYGCHREGKNGILPPVMSGKVKSKPVLKYGTVEVRARIPKGDWLWPAIWMLPRDSHYGGWPRSGEIDIMESRGNVRASGHGVNEVSSTLHWGTSAGDNHYGQTTHAKQAADWSNSFHTWRLEWTHDHIATFVDNQQILRVTPPSGGFSELGHTSNIWAGNDKMAPFDKEFYAIFNVAVGGTNGFFPENWDYGYPKPWSNTSPHAAQDWWNGRSKWESSWQGDKVAMEIDYIEMRYL

SEQ ID NO: 302 - protein, 626 aa, Bacillus subtilis
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 303 - protein, 442 aa, Bacillus subtilis
MFGYSMVQMVRANAHKLDWPLRETVLQLYKPFKWTPCFLHKFFETKLQNRKKMSVIIEFEEGCHETGFQMAGEVLQKEKRSKLKSRFNKINCCSAEVTPSALHSLLSECSNIRKVYLNREVKALLDTATEASHAKEVVRNGQTLTGKGVTVAVVDTGIYPHPDLEGRIIGFADMVNQKTEPYDDNGHGTHCAGDVASSGASSSGQYRGPAPEANLIGVKVLNKQGSGTLADIIEGVEWCIQYNEDNPDEPIDIMSMSLGGDALRYDHEQEDPLVRAVEEAWSAGIVVCVAAGNSGPDSQTIASPGVSEKVITVGALDDNNTASSDDDTVASFSSRGPTVYGKEKPDILAPGVNIISLRSPNSYIDKLQKSSRVGSQYFTMSGTSMATPICAGIAALILQQNPDLTPDEVKELLKNGTDKWKDEDPNIYGAGAVNAENSVPGQ

SEQ ID NO: 304 - protein, 778 aa, Bacillus subtilis
APASSKTSADLEKAEVFGDIDMTTSKKTTVIVELKEKSLAEAKEAGESQSKSKLKTARTKAKNKAIKAVKNGKVNREYEQVFSGFSMKLPANEIPKLLAVKDVKAVYPNVTYKTDNMKDKDVTISEDAVSPQMDDSAPYIGANDAWDLGYTGKGIKVAIIDTGVEYNHPDLKKNFGQYKGYDFVDNDYDPKETPTGDPRGEATDHGTHVAGTVAANGTIKGVAPDATLLAYRVLGPGGSGTTENVIAGVERAVQDGADVMNLSLGNSLNNPDWATSTALDWAMSEGVVAVTSNGNSGPNGWTVGSPGTSREAISVGATQLPLNEYAVTFGSYSSAKVMGYNKEDDVKALNNKEVELVEAGIGEAKDFEGKDLTGKVAVVKRGSIAFVDKADNAKKAGAIGMVVYNNLSGEIEANVPGMSVPTIKLSLEDGEKLVSALKAGETKTTFKLTVSKALGEQVADFSSRGPVMDTWMIKPDISAPGVNIVSTIPTHDPDHPYGYGSKQGTSMASPHIAGAVAVIKQAKPKWSVEQIKAAIMNTAVTLKDSDGEVYPHNAQGAGSARIMNAIKADSLVSPGSYSYGTFLKENGNETKNETFTIENQSSIRKSYTLEYSFNGSGISTSGTSRVVIPAHQTGKATAKVKVNTKKTKAGTYEGTVIVREGGKTVAKVPTLLIVKEPDYPRVTSVSVSEGSVQGTYQIETYLPAGAEELAFLVYDSNLDFAGQAGIYKNQDKGYQYFDWDGTINGGTKLPAGEYYLLAYAANKGKSSQVLTEEPFTVE

SEQ ID NO: 305 - protein, 373 aa, Engyodontium album
MMAPAVEQRSEAAPLIEARGEMVANKYIVKFKEGSALSALDAAMEKISGKPDHVYKNVFSGFAATLDENMVRVLRAHPDVEYIEQDAVVTINAAQTNAPWGLARISSTSPGTSTYYYDESAGQGSCVYVIDTGIEASHPEFEGRAQMVKTYYYSSRDGNGHGTHCAGTVGSRTYGVAKKTQLFGVKVLDDNGSGQYSTIIAGMDFVASDKNNRNCPKGVVASLSLGGGYSSSVNSAAARLQSSGVMVAVAAGNNNADARNYSPASEPSVCTVGASDRYDRRSSFSNYGSVLDIFGPGTSILSTWIGGSTRSISGTSMATPHVAGLAAYLMTLGKTTAASACRYIADTANKGDLSNIPFGTVNLLAYNNYQAVD

SEQ ID NO: 306 - protein, 374 aa, Aspergillus saitoi
APAPTRKGFTINQIARPANKTRTVNLPGLYARSLAKFGGTVPQSVKEAASKGSAVTTPQNNDEEYLTPVTVGKSTLHLDFDTGSADLWVFSDELPSSEQTGHDLYTPSSSATKLSGYSWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESYEAGGYVFSCSTDLPDFTVVIGDYKAVVPGKYINYAPVSTGSSTCYGGIQSNSGLGLSILGDVFLKSQYVVFNSEGPKLGFAAQA

SEQ ID NO: 307 - protein, 296 aa, Bacillus circulans
ATGFYVNGGKLYDSTGKPFYMRGINHGHSWFKNDLNTAIPAIAKTGANTVRIVLSNGTQYTKDDLNSVKNIINVVNANKMIAVLEVHDATGKDDFNSLDAAVNYWISIKEALIGKEDRVIVNIANEWYGTWNGSAWADGYKKAIPKLRDAGIKNTLIVDAAGWGQYPQSIVDYGQSVFAADSQKNTAFSIHMYEYAGKDAATVKSNMENVLNKGLALIIGEFGGYHTNGDVDEYAIMKYGLEKGVGWLAWSWYGNSSGLNYLDLATGPNGSLTSYGNTVVNDTYGIKNTSQKAGIF

SEQ ID NO: 308 - protein, 336 aa, Bacillus subtilis
HTVSPVNPNAQQTTKTVMNWLAHLPNRTENRVLSGAFGGYSHDTFSMAEADRIRSATGQSPAIYGCDYARGWLETANIEDSIDVSCNGDLMSYWKNGGIPQISLHLANPAFQSGHFKTPITNDQYKKILDSSTVEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSAAVNKGASALYHDSWTLNKGEIWNGDSLTPIVE

SEQ ID NO: 309 - protein, 349 aa, Aspergillus niger
APSRVSDFTKRSTCTFTDAATASESKTSCSDIVLKDITVPAGETLNLKDPNDGTTVTFEGTTTWEYEEWDGPLLRISGKDITVTQSSDAVLDGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCSDWTMSGIDITGGETSSDCENVPSGASCDQ

SEQ ID NO: 310 - protein, 321 aa, Bacillus subtilis
AVDFPNTSTNGLLGFAGNAKNEKGISKTGTTGGKNGQIVYIQSVNDLKTHLGGSTPKILVLQNDLSASAKTTVTIGSNKTLVGSYAKKTLKNIYLTTSSAFGNVIFQNLTFEHSPQINGNNDIQLYLDSGMNYWIDHVTFSGHSYNASGSDLDKLVYIGKSADYITISNSKFANHKYGLILGYPDDSQHQYDGYPHMTIANNYFENLYVRGPGLMRYGYFHVKNNYSNNFNQAITIATKAKIYSEYNYFGKGSEKGGILDDKGTGYFKDIGSYPSLNKQTSPLTSWNPGSNYSYRVQTPEYTKEFVTKYAGSQSTTLVFGY

SEQ ID NO: 311 - protein, 310 aa, Triticum aestivum
ELPLVEHPAKNDGSLSLLVVGDWGRNGTYNQSRVAEQMGKVGERLDIDFVVSTGDNFYENGLTGVHDQQFEESFTNIYTAQSLQKPWYLVLGNHDYRGDALAQLDPVMRKLDERFVCMRSFLVNAEIVEFFFIDTTPFQLKYWTHPKDSHYDWRGVAPRKDYIANLLKDLDEAMKKSTAKWKIAIGHHTMRSVSDHGDTEELLQLLLPVLKVNGIDFYINGHDHCLEHISSRDSPIQYFTSGGGSKAWRGVYQPNDDKIQFFYDGQGFMSLQLNQDQADFIFYDVSGKVLYEFTSHKTNHFQPSIYVTAE

SEQ ID NO: 312 - protein, 447 aa, Triticum aestivum
RSEFPSTDMPLDSEWFATPKGYNAPQQVHITQGDYDGKAVIVSWVTPSEPAPSQVFYSKEENRYDQKAEGTMTNYTFYDYKSGYIHHCLVDGLEYNTKYYYKIGTGDSAREFWFQTPPAIDTDASYTFGIIGDLGQTFNSLSTLQHYLKSGGESVLFVGDLSYADRYQHNDGIRWDSWGRFVERSTAYQPWIWNSGNHEIEYRPDLGETSTFKPYLHRYSTPYLASKSSSPMWYAVRRASAHIIVLSSYSPFVKYTPQWMWLKGELKRVDREKTPWLIVLMHAPMYNSNNAHYMEGESMRAAFEKWFVKYKVDLVFAGHVHAYERSYRISNINYNVTSGNRYPVPDKSAPVYITVGDGGNQEGLAWRFNDPQPDYSAFREASFGHSTLQLVNRTHAVYQWNRNDDGKHVPTDNVVFHNQYWAGNTRRRRLKKKHLRYESLQSLMSML

SEQ ID NO: 313 - protein, 530 aa, Triticum aestivum
AAEPASTLTGPSRPVTVALRKDRGHAVDLPDTDPRVQRRATGWAPEQITVALSAAPTSAWVSWITGEFQMGGTVKPLNPGTVASVVRYGLAADSLVHEATGDALVYSQLYPFEGLQNYTSGIIHHVRLQGLEPATKYYYQCGDPGIPGAMSAVHAFRTMPAVGPRSYPGRIAVVGDLGLTYNTTSTVDHMVSNRPDLVLLVGDVCYANMYLTNGTGADCYSCAFGKSTPIHETYQPRWDYWGRYMEAVTSGTPMMVVEGNHEIEEQIGNKTFAAYRSRFAFPSTESGSFSPFYYSFDAGGIHFIMLAAYADYSRSGEQYRWLVKDLAKVDRAVTPWLVAGWHAPWYTTYKAHYREVECMRVAMEELLYSHGLDIAFTGHVHAYERSNRVFNYTLDPCGAVHISVGDGGNREKMATTHADEPGHCPDPRPKPNAFIGCFCAFNFTSGPAAGRFCWDRQPDYSAYRESSFGHGILEVKNETHALWRWHRNQDHYGSAGDEIYIVREPHRCLHKHNSTRPAHGRQNTTRESGG

SEQ ID NO: 314 - protein, 521 aa, Triticum aestivum
AAEPASTLTGPSRPVTVTLREDRGHAVDLPDTDPRVQRRATGWAPEQIAVALSAAPTSAWVSWITGEFQMGGTVKPLDPGTVASVVRYGLAADSLVRQATGDALVYSQLYPFEGLQNYTSGIIHHVRLQGLEPATKYYYQCGDPALPGAMSAVHAFRTMPAVGPRSYPGRIAVVGDLGLTYNTTSTVDHMASNRPDLVLLLGDVSYANLYLTNGTGADCYSCAFGKSTPIHETYQPRWDYWGRYMEAVTSGTPMVVVEGNHEIEEQIGNKTFAAYRSRFAFPSTESGSFSPFYYSFDAGGIHFVMLGAYADYGRSGEQYRWLEKDLAKVDRSVTPWLVAGWHAPWYTTYKAHYREVECMRVAMEELLYSHGLDIAFTGHVHAYERSNRVFNYTLDPCGAVHISVGDGGNREKMATTHADEPGHCPEPRAKPNAFIGGFCAFNFTSGPAAGRFCWDRQPDYSAYRESSFGHGILEVKNETHALWRWHRNQDMYGSAGDEIYIVREPHRCLHKHNSTRPTHGR

SEQ ID NO: 315 - protein, 521 aa, Triticum aestivum
AAAAEPASTLEGPSWPVTVPLREDRGHAVDLPDTDPRVQRRVTGWAPEQIAVALSAAPTSAWVSWITGDFQMGGAVKPLDPGTVGSVVRYGLAADSLVREATGDALVYSQLYPFEGLQNYTSGIIHHVRLQGLEPGTKYYYQCGDPAIPGATSAVHAFRTMPAVGPRSYPGRIAVVGDLGLTYNTTSTVEHMASNQPDLVLLLGDVSYANLYLTNGTGTDCYSCSFAKSTPIHETYQPRWDYWGRYMESVTSTTPMMVVEGNHEIEQQIGNKTFAAYSARFAFPSKESDSFSPFYYSFDAGGIHFIMLAAYAAYSKSGEQYRWLEKDLAKVDRSVTPWLVAGWHAPWYSTYKAHYREAECMRVAMEELLYSYGLDIVFTGHVHAYERSNRVFNYTLDPCGAVHISVGDGGNREKMATTHADDPGRCPEPLSTPDDFMGGFCAFNFTSDPAAGSFCWDRQPDYSAYRESSFGHGILEVKNETHALWKWHRNQDLYQGGVGDEIYIVREPERCLLKSSIAAYF

SEQ ID NO: 316 - protein, 207 aa, Bacillus subtilis
AYDDLHEGYATYTGSGYSGGAFLLDPIPSDMEITAINPADLNYGGVKAALAGSYLEVEGPKGKTTVYVTDLYPEGARGALDLSPNAFRKIGNMKDGKINIKWRVVKAPITGNFTYRIKEGSSRWWAAIQVRNHKYPVMKMEYEKDGKWINMEKMDYNHFVSTNLGTGSLKVRMTDIRGKVVKDTIPKLPESGTSKAYTVPGHVQFPE

SEQ ID NO: 317 - protein, 24 aa, Bacillus thuringiensis
MKKKVLALAAAITLVAPLQSVAFA

SEQ ID NO: 318 - protein, 28 aa, Bacillus thuringiensis
MKGKLLKGVLSLGVGLGALYSGTSAQAE

SEQ ID NO: 319 - protein, 24 aa, Bacillus cereus
MKKKVLALAAAITVVAPLQSVAFA

SEQ ID NO: 320 - protein, 29 aa, Clostridium perfringens
MKRKICKALICATLATSLWAGASTKVYAW

SEQ ID NO: 321 - protein, 14 aa, Streptomyces chromofuscus
MLAGPLAAALPARA

SEQ ID NO: 322 - protein, 46 aa, Streptomyces chromofuscus
MTSRYRSSEAHQGLASFSPRRRTVVKAAAATAVLAGPLAAALPARA

SEQ ID NO: 323 - protein, 24 aa, Bacillus cereus
MKKKVLALAAAITLVAPLQNVAFA

SEQ ID NO: 324 - protein, 31 aa, Bacillus subtilis
MKFVKRRIIALVTILMLSVTSLFALQPSAKA

SEQ ID NO: 325 - protein, 44 aa, Burkholderia cepacia
MARTMRSRVVAGAVACAMSIAPFAGTTAVMTLATTHAAMAATAP

SEQ ID NO: 326 - protein, 23 aa, Pseudomonas fluorescens
MGIFDYKNLGTEGSKTLFADAMA

SEQ ID NO: 327 - protein, 28 aa, Caldicellulosiruptor saccharolyticus
MCENLEMLNLSLAKTYKDYFKIGAAVTA

SEQ ID NO: 328 - protein, 28 aa, Bacillus subtilis
MFKFKKNFLVGLSAALMSISLFSATASA

SEQ ID NO: 329 - protein, 26 aa, Bacillus subtilis
MRKKCSVCLWILVLLLSCLSGKSAYA

SEQ ID NO: 330 - protein, 27 aa, Geobacillus stearothermophilus
MKLKKKMLTLLLTASMSFGLFGATSSA

SEQ ID NO: 331 - protein, 32 aa, Bacillus subtilis
MIPRIKKTICVLLVCFTMLSVMLGPGATEVLA

SEQ ID NO: 332 - protein, 35 aa, Bacillus subtilis
MKISMQKADFWKKAAISLLVFTMFFTLMMSETVFA

SEQ ID NO: 333 - protein, 40 aa, Streptomyces sp.
MHSQHRTARIALAVVLTAIPASLATAGVGYASTQASTAVK

SEQ ID NO: 334 - protein, 29 aa, Bacillus subtilis
MKRSISIFITCLLITLLTMGGMIASPASA

SEQ ID NO: 335 - protein, 28 aa, Bacillus subtilis
MPYLKRVLLLLVTGLFMSLFAVTATASA

SEQ ID NO: 336 - protein, 27 aa, Clostridium thermocellum
MKNRVISLLMASLLLVLSVIVAPFYKA

SEQ ID NO: 337 - protein, 38 aa, Bacillus circulans
MKRSQTSEKRYRQRVLSLFLAVVMLASIGLLPTSKVQA

SEQ ID NO: 338 - protein, 38 aa, Bacillus circulans
MKPSHFTEKRFMKKVLGLFLVVVMLASVGVLPTSKVQA

SEQ ID NO: 339 - protein, 32 aa, Paenibacillus pabuli
MFKKWKKFGISSLALVLVAAVAFTGWSAKASA

SEQ ID NO: 340 - protein, 29 aa, Bacillus licheniformis
MKNNHLLKSILLWGAVCIIVLAGPLSAFA

SEQ ID NO: 341 - protein, 33 aa, Bacillus subtilis
MFAKRFKTSLLPLFAGFLLLFHLVLAGPAAASA

SEQ ID NO: 342 - protein, 28 aa, Bacillus subtilis
MKKGIIRFLLVSFVLFFALSTGITGVQA

SEQ ID NO: 343 - protein, 20 aa, Aspergillus saitoi
MVVFSKTAALVLGLSTAVSA

SEQ ID NO: 344 - protein, 28 aa, Bacillus circulans
MAKLQKGTILTVIAALMFVILGSAAPKA

SEQ ID NO: 345 - protein, 26 aa, Bacillus subtilis
MFKKHTISLLIIFLLASAVLAKPIEA

SEQ ID NO: 346 - protein, 21 aa, Aspergillus niger
MPSAKPLFCLATLAGAALAAP

SEQ ID NO: 347 - protein, 24 aa, Bacillus subtilis
MKRLCLWFTVFSLFLVLLPGKALG

SEQ ID NO: 348 - protein, 25 aa, Triticum aestivum
MARGSMAAVLAVLAVAALRCAPAAA

SEQ ID NO: 349 - protein, 30 aa, Triticum aestivum
MRGLGFAALSLHVLLCLANGVSSRRTSSYV

SEQ ID NO: 350 - protein, 18 aa, Triticum aestivum
MWWGSLRLLLLLAAAVAA

SEQ ID NO: 351 - protein, 15 aa, Triticum aestivum
MGIWRGSLPLLLLAA

SEQ ID NO: 352 - protein, 32 aa, Bacillus subtilis
MKKFPKKLLPIAVLSSIAFSSLASGSVPEASA

SEQ ID NO: 353 - protein, 41 aa, Bacillus subtilis
MKKMSLFQNMKSKLLPIAAVSVLTAGIFAGAELQQTEKASA

SEQ ID NO: 354 - protein, 26 aa, Bacillus subtilis
MKVPKTMLLSTAAGLLLSLTATSVSA

SEQ ID NO: 355 - protein, 25 aa, Bacillus subtilis
MKKIMSAFVGMVLLTIFCFSPQASA

SEQ ID NO: 356 - protein, 46 aa, Bacillus thuringiensis
MPLNISFILKGEMAMRSQKFTLLLLSLLLFLPLFLTNFITPNLALA

SEQ ID NO: 357 - protein, 27 aa, Bacillus thuringiensis
MLNKFKFFCCILVMFLLLPLSPFQTQA

SEQ ID NO: 358 - protein, 43 aa, Bacillus thuringiensis
MNKIIHLDNFLYRSVNMLNKFKFFCCILVMFLLLPLSPFQTQA

SEQ ID NO: 359 - protein, 23 aa, Bacillus pseudomycoides
MEYKPLIMGYLHTWSKGFIGGYE

SEQ ID NO: 360 - protein, 25 aa, Bacillus thuringiensis
MKKKVLALAAAITLVAPLQSVAFAH

SEQ ID NO: 361 - DNA, 9 bp, Artificial Sequence
  Consensus sequence
  misc_feature (5)..(7): n is a, c, g, or t
  misc_feature (9)..(9): n is a, c, g, or t
catannntn

SEQ ID NO: 362 - DNA, 36 bp, Artificial Sequence
  Synthetic construct
gcagctgcggcagctggctccatcggcgcagcaagc

SEQ ID NO: 363 - DNA, 36 bp, Artificial Sequence
  Synthetic construct
ctgcagttactcgagctgcagttaaggggaaacaca

SEQ ID NO: 364 - DNA, 38 bp, Artificial Sequence
  Synthetic construct
gcagctgcggcagctatgaaaaaacgaaaagtgttaat

SEQ ID NO: 365 - DNA, 36 bp, Artificial Sequence
  Synthetic construct
ctgcagttactcgagttatcctatctcatagccttt

SEQ ID NO: 366 - protein, 385 aa, Gallus gallus
GSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKTFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 367 - protein, 764 aa, Bacillus anthracis
MKKRKVLIPLMALSTILVSSTGNLEVIQAEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSETRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNATNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 368 - DNA, 21 bp, Artificial Sequence
  Synthetic construct
actcctacgggaggcagcagt

SEQ ID NO: 369 - DNA, 16 bp, Artificial Sequence
  Synthetic construct
gggttgcgctcgttgc

SEQ ID NO: 370 - DNA, 16 bp, Artificial Sequence
  Synthetic construct
gggttgcgctcgttac

SEQ ID NO: 371 - protein, 17 aa, Bacillus anthracis
MKILSDLVGPTFPPVPT

SEQ ID NO: 372 - protein, 17 aa, Bacillus anthracis
MIIGPENIGPTFPVLPP

SEQ ID NO: 373 - protein, 262 aa, Listeria monocytogenes
CCDEYLQTPAAPHDIDSKLPHKLSWSADNPTNTDVNTHYWLFKQAEKILAKDVNHMRANLMNELKKFDKQIAQGIYDADHKNPYYDTSTFLSHFYNPDRDNTYLPGFANAKITGAKYFNQSVTDYREGKFDTAFYKLGLAIHYYTDISQPMHANNFTAISYPPGYHCAYENYVDTIKHNYQATEDMVAKRFCSDDVKDWLYENAKRAKADYPKIVNAKTKKSYLVGNSEWKKDTVEPTGARLRDSQQTLAGFLEFWSKKTNE

SEQ ID NO: 374 - protein, 238 aa, Listeria monocytogenes
WSADNPTNTDVNTHYWLFKQAEKILAKDVNHMRANLMNELKKFDKQIAQGIYDADHKNPYYDTSTFLSHFYNPDRDNTYLPGFANAKITGAKYFNQSVTDYREGKFDTAFYKLGLAIHYYTDISQPMHANNFTAISYPPGYHCAYENYVDTIKHNYQATEDMVAKRFCSDDVKDWLYENAKRAKADYPKIVNAKTKKSYLVGNSEWKKDTVEPTGARLRDSQQTLAGFLEFWSKKTNE

SEQ ID NO: 375 - protein, 298 aa, Bacillus thuringiensis
ASSVNELENWSKWMQPIPDNIPLARISIPGTHDSGTFKLQNPIKQVWGMTQEYDFRYQMDHGARIFDIRGRLTDDNTIVLHHGPLYLYVTLHEFINEAKQFLKDNPSETIIMSLKKEYEDMKGAEDSFSSTFEKNYFVDPIFLKTEGNIKLGDARGKIVLLKRYSGSNESGGYNNFYWPDNETFTTTVNKNVNVTVQDKYKVSYDEKVKSIKDTINETMNNSEDLNHLYINFTSLSSGGTAWNSPYYYASYINPEIAAYIKQENPKRVGWVIQDYISDKWSPILYQEVIRANKSLIKE

SEQ ID NO: 376 - protein, 27 aa, Listeria monocytogenes
MKFKNVVLGMCLTASVLVFPVTIKANA

SEQ ID NO: 377 - protein, 31 aa, Bacillus thuringiensis
MSNKKLILKLFICSTIFITFVFALHDKQVVA

SEQ ID NO: 378 - protein, 243 aa, Bacillus thuringiensis
KEEKVKLTEQQLMADLWYQTAGETKALYYQGYNIGQLKLDAVLAKGTEKKPAIVLDLDETVLDNSPHQAMSVKTGKGYPYKWDDWINKAEAEALPGAIDFLKYTESKGVDIYYISNRKTNQLDATIKNLERVGAPQATKEHILLQDPKEKGKEKRRELVSQTHDIVLFFGDNLSDFTGFDGKSVKDRNQTVEDSKVQFGEKFIIFPNPMYGDWEGALYDYDFKKSDAEKDKIRRDNLKSFEVK

SEQ ID NO: 379 - protein, 32 aa, Bacillus thuringiensis
MKMKRGITTLLSVAVLSTSLVACSGTPEKTVA

SEQ ID NO: 380 - protein, 356 aa, Bacillus subtilis
HYVNEEHHFKVTAHTETDPVASGDDAADDPAIWVHEKHPEKSKLITTNKKSGLVVYDLDGKQLHSYEFGKLNNVDLRYDFPLNGEKIDIAAASNRSEGKNTIEVYAIDGDKGKLKSITDPNHPISTNISEVYGFSLYHSQKTGAFYALVTGKQGEFEQYEIVDGGKGYVTGKKVREFKLNSQTEGLVADDEYGNLYIAEEDEAIWKFNAEPGGGSKGQVVDRATGDHLTADIEGLTIYYAPNGKGYLMASSQGNNSYAMYERQGKNRYVANFEITDGEKIDGTSDTDGIDVLGFGLGPKYPYGIFVAQDGENIDNGQAVNQNFKIVSWEQIAQHLGEMPDLHKQVNPRKLKDRSDG

SEQ ID NO: 381 - protein, 156 aa, Bacillus anthracis
MSCNCNEDHHEHDCDFNCVSNVVRFIHELQDCATTTCGSGCEVPFLGAHNTASVANTRPFILYTKAGAPFEAFAPSASLTSCRSPIFRVESIDDDDCAVLRVLTVVLGDNSPVPPTDDPICTFLAVPNARLVSTSTCITVDLSCFCAIQCLRDVTI

SEQ ID NO: 382 - protein, 296 aa, Bacillus thuringiensis
MSNNNYSNGLNPDESLSASAFDPNLVGPTLPPIPPFTLPTGPTGPTGPTGPTGPTGGGTGITGPTGPTGDTGATGPTGPTGDTGATGLTGPTGDTGATGPTGPTGDTGATGPTGPTGDTGATGLTGPTGDTGATGPTGPTGATGPTGATGPTGATGPTGPSGLGLPAGLYAFNSGGISLDLGINDPVPFNTVGSQFGTAISQLDADTFVISETGFYKITVIAYTATVSLLGGLTIQVNGVPVPGTGSSLISLGAPIVIQAITQITTTPSLVEVIVTGLGLSLALGTSASIIIEKVA

SEQ ID NO: 383 - protein, 166 aa, Bacillus thuringiensis
MSNNNYSNGLNPDESLSASAFDPNLVGPTLPPIPPFTLPTGPTGPTGPTGPTGPTGGGTGITGPTGPTGDTGATGPTGPTGDTGATGLTGPTGDTGATGPTGPTGDTGATGPTGPTGDTGATGLTGPTGDTGATGPTGPTGATGPTGATGPTGATGPTGPSGLGLP

SEQ ID NO: 384 - protein, 322 aa, Bacillus anthracis
MSNNNYSNGLNPDESLSASAFDPNLVGPTLPPIPPFTLPTGPTGPTGPTGPTGPTGPTGPTGPTGPTGPTGDTGTTGPTGPTGPTGPTGPTGPTGPTGPTGPTGPTGPTGPTGPTGDTGTTGPTGPTGPTGPTGPTGDTGTTGPTGPTGPTGPTGPTGPTGPTGPTGPTGPTGATGLTGPTGPTGPSGLGLPAGLYAFNSGGISLDLGINDPVPFNTVGSQFGTAISQLDADTFVISETGFYKITVIANTATASVLGGLTIQVNGVPVPGTGSSLISLGAPIVIQAITQITTTPSLVEVIVTGLGLSLALGTSASIIIEKVA

SEQ ID NO: 385 - protein, 196 aa, Bacillus anthracis
MSNNNYSNGLNPDESLSASAFDPNLVGPTLPPIPPFTLPTGPTGPTGPTGPTGPTGPTGPTGPTGPTGPTGDTGTTGPTGPTGPTGPTGPTGPTGPTGPTGPTGPTGPTGPTGPTGDTGTTGPTGPTGPTGPTGPTGDTGTTGPTGPTGPTGPTGPTGPTGPTGPTGPTGPTGATGLTGPTGPTGPSGLGLPAGLY

SEQ ID NO: 386 - protein, 8 aa, Artificial Sequence
  Synthetic construct
AAAAADLE

SEQ ID NO: 387 - protein, 8 aa, Artificial Sequence
  Synthetic construct
AAAAAALE

SEQ ID NO: 388 - protein, 24 aa, Listeria monocytogenes
CCDEYLQTPAAPHDIDSKLPHKLS

What is claimed is:

1. A fusion protein comprising:
(A) a targeting sequence that targets the fusion protein to the exosporium of a recombinant *Bacillus cereus* family member; and
(B) a phospholipase C enzyme wherein the phospholipase C enzyme comprises: an amino acid sequence having at least 95% sequence identity to the amino acid sequence of SEQ ID NO: 373 or SEQ ID NO: 374 and having phospholipase C activity.

2. A recombinant *Bacillus cereus* family member comprising the fusion protein of claim 1.

3. Exosporium fragments derived from the recombinant *Bacillus cereus* family of claim 2.

4. A formulation comprising the recombinant *Bacillus cereus* family member of claim 2 or the exosporium fragments of claim 3 and an agriculturally acceptable carrier.

5. A method for stimulating plant growth and/or promoting plant health, comprising applying the recombinant *Bacillus cereus* family member of claim 2 or the exosporium fragments of claim 3 to a plant growth medium, a plant, a plant see, or an area surrounding a plant or a plant seed.

6. A method for delivering an enzyme to an animal, comprising feeding to the animal the recombinant *Bacillus cereus* family member of claim 2, the exosporium fragments of claim 3, or a combination thereof.

7. The fusion protein of claim 1, wherein the phospholipase C enzyme further comprises a signal peptide.

8. The fusion protein of claim 7, wherein the signal peptide is present at the amino terminus of the phospholipase C enzyme.

9. The fusion protein of claim 7, wherein the phospholipase C enzyme further comprises a signal peptide at its amino terminus, wherein said signal peptide is selected from the group consisting of the amino acid sequence of SEQ ID NO: 340, SEQ ID NO: 339, SEQ ID NO: 334, SEQ ID NO: 335, SEQ ID NO: 336, SEQ ID NO: 337, SEQ ID NO: 338, and SEQ ID NO: 341.

\* \* \* \* \*